US012630890B2

(12) United States Patent
Baum et al.

(10) Patent No.: US 12,630,890 B2
(45) Date of Patent: May 19, 2026

(54) ANTI-SARS-CoV-2-SPIKE GLYCOPROTEIN ANTIBODIES AND ANTIGEN-BINDING FRAGMENTS

(71) Applicant: Regeneron Pharmaceuticals, Inc., Tarrytown, NY (US)

(72) Inventors: Alina Baum, Pleasantville, NY (US); Benjamin Fulton, New York, NY (US); Christos Kyratsous, Irvington, NY (US); George D. Yancopoulos, Yorktown Heights, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 452 days.

(21) Appl. No.: 17/927,649

(22) PCT Filed: May 26, 2021

(86) PCT No.: PCT/US2021/034187
§ 371 (c)(1),
(2) Date: Nov. 23, 2022

(87) PCT Pub. No.: WO2021/242815
PCT Pub. Date: Dec. 2, 2021

(65) Prior Publication Data

US 2024/0043504 A1 Feb. 8, 2024

Related U.S. Application Data

(60) Provisional application No. 63/159,437, filed on Mar. 10, 2021, provisional application No. 63/145,389, filed on Feb. 3, 2021, provisional application No. 63/142,472, filed on Jan. 27, 2021, provisional application No. 63/141,956, filed on Jan. 26, 2021, provisional application No. 63/112,143, filed on Nov. 10, 2020, provisional application No. 63/093,888, filed on Oct. 20, 2020, provisional application No. 63/033,198, filed on Jun. 1, 2020, provisional application No. 63/030,260, filed on May 26, 2020.

(51) Int. Cl.

| | |
|---|---|
| ***C07K 16/10*** | (2006.01) |
| ***A61P 31/14*** | (2006.01) |
| ***C07K 16/102*** | (2026.01) |
| ***C07K 16/104*** | (2026.01) |
| ***C12Q 1/70*** | (2006.01) |
| ***G01N 33/569*** | (2006.01) |
| *A61K 39/00* | (2006.01) |

(52) U.S. Cl.
CPC .............. *C12Q 1/701* (2013.01); *A61P 31/14* (2018.01); *C07K 16/102* (2026.01); *C07K 16/104* (2026.01); *G01N 33/56983* (2013.01); *A61K 2039/505* (2013.01); *A61K 2039/507* (2013.01); *C07K 2317/21* (2013.01); *C07K 2317/24* (2013.01); *C07K 2317/73* (2013.01); *C07K 2317/732* (2013.01); *C07K 2317/76* (2013.01); *C07K 2317/92* (2013.01); *C12Q 2600/136* (2013.01); *C12Q 2600/156* (2013.01); *G01N 2333/165* (2013.01); *G01N 2500/10* (2013.01)

(58) Field of Classification Search
None
See application file for complete search history.

(56) References Cited

U.S. PATENT DOCUMENTS

| | | | |
|---|---|---|---|
| 5,908,635 | A | 6/1999 | Thierry |
| 10,787,501 | B1 | 9/2020 | Babb et al. |
| 10,822,379 | B1 | 11/2020 | Dimitrov et al. |
| 10,954,289 | B1 | 3/2021 | Babb et al. |
| 10,975,139 | B1 | 4/2021 | Babb et al. |
| 11,020,474 | B1 | 6/2021 | Xiang et al. |
| 11,021,531 | B1 | 6/2021 | Glanville et al. |
| 11,021,532 | B1 | 6/2021 | Glanville et al. |
| 11,028,150 | B1 | 6/2021 | Glanville et al. |
| 11,028,167 | B1 | 6/2021 | Glanville et al. |
| 11,732,030 | B2 | 8/2023 | Babb et al. |
| 11,999,777 | B2 | 6/2024 | Ganguly et al. |
| 2006/0240551 | A1 | 10/2006 | Jiang et al. |
| 2011/0159001 | A1 | 6/2011 | Lanzavecchia |
| 2017/0096455 | A1 | 4/2017 | Baric et al. |
| 2017/0355756 | A1 | 12/2017 | Julien et al. |
| 2021/0031123 | A1 | 2/2021 | Liu et al. |
| 2021/0093709 | A1 | 4/2021 | Wu et al. |
| 2021/0260201 | A1 | 8/2021 | Chukly et al. |
| 2021/0275665 | A1 | 9/2021 | Cho |

(Continued)

FOREIGN PATENT DOCUMENTS

| | | | |
|---|---|---|---|
| CN | 111088283 | A | 5/2020 |
| CN | 111285933 | A | 6/2020 |

(Continued)

OTHER PUBLICATIONS

Wang et al., Vaccines and Antiviral Agents vol. 92 Issue 10 (Year: 2018).*

(Continued)

*Primary Examiner* — Shanon A. Foley
*Assistant Examiner* — Myron G H
(74) *Attorney, Agent, or Firm* — Schwabe, Williamson & Wyatt PC; Gabe Amodeo

(57) ABSTRACT

The present disclosure provides antibodies and antigen-binding fragments thereof that bind specifically to a coronavirus spike protein and methods of using such antibodies and fragments for treating or preventing viral infections (e.g., coronavirus infections).

2 Claims, 54 Drawing Sheets

Specification includes a Sequence Listing.

(56) References Cited

U.S. PATENT DOCUMENTS

2021/0277093 A1 9/2021 Mond et al.
2021/0388065 A1 12/2021 Lu et al.

FOREIGN PATENT DOCUMENTS

CN 111303254 A 6/2020
CN 111303279 A 6/2020
CN 111303280 A 6/2020
CN 111333704 B 6/2020
CN 111333722 A 6/2020
CN 111420048 A 7/2020
CN 111423508 A 7/2020
CN 111440229 A 7/2020
CN 111471105 A 7/2020
CN 111499692 A 8/2020
CN 111499765 A 8/2020
CN 111518773 A 8/2020
CN 111560399 A 8/2020
CN 111574614 A 8/2020
CN 111592594 A 8/2020
CN 111592595 B 8/2020
CN 111607003 A 9/2020
CN 111620945 B 9/2020
CN 111620946 B 9/2020
CN 111647053 A 9/2020
CN 111647076 B 9/2020
CN 111647077 B 9/2020
CN 111662379 B 9/2020
CN 111690058 B 9/2020
CN 111690059 A 9/2020
CN 111690060 A 9/2020
CN 111714621 B 9/2020
CN 111718411 A 9/2020
CN 111732654 B 10/2020
CN 111732655 A 10/2020
CN 111732664 B 10/2020
CN 111748032 B 10/2020
CN 111778218 A 10/2020
CN 111793129 A 10/2020
CN 111825762 A 10/2020
CN 111825771 A 10/2020
CN 111848750 A 10/2020
CN 111848751 A 10/2020
CN 111848789 A 10/2020
CN 111875701 A 11/2020
CN 111909260 A 11/2020
CN 111909261 A 11/2020
CN 111909262 A 11/2020
CN 111909263 A 11/2020
CN 111925439 A 11/2020
CN 111925440 A 11/2020
CN 111925441 A 11/2020
CN 111925442 A 11/2020
CN 111925443 A 11/2020
CN 111925444 A 11/2020
CN 111944026 A 11/2020
CN 111978377 A 11/2020
CN 111978395 A 11/2020
CN 111978396 A 11/2020
CN 111978397 A 11/2020
CN 111978398 A 11/2020
CN 111978399 A 11/2020
CN 111995672 A 11/2020
CN 111995674 A 11/2020
CN 111995678 B 11/2020
CN 112010962 A 12/2020
CN 112010963 A 12/2020
CN 112010964 A 12/2020
CN 112010967 B 12/2020
CN 112062838 B 12/2020
CN 112062839 A 12/2020
CN 112062840 A 12/2020
CN 112062859 A 12/2020
CN 112076316 A 12/2020
CN 112094326 A 12/2020
CN 112094327 A 12/2020
CN 112094340 A 12/2020
CN 112094342 A 12/2020
CN 112094343 A 12/2020
CN 112125973 A 12/2020
CN 112159469 A 1/2021
CN 112175071 A 1/2021
CN 112175073 A 1/2021
CN 112194711 A 1/2021
CN 112210004 A 1/2021
CN 112250763 A 1/2021
CN 112251414 A 1/2021
CN 112300274 A 2/2021
CN 112341541 A 2/2021
CN 112341542 B 2/2021
CN 112390879 B 2/2021
CN 112409479 A 2/2021
CN 112409488 A 2/2021
CN 112430265 A 3/2021
CN 112442120 A 3/2021
CN 112485455 A 3/2021
CN 112500480 A 3/2021
CN 112500481 A 3/2021
CN 112513076 A 3/2021
CN 112521494 A 3/2021
CN 112521496 A 3/2021
CN 112522203 A 3/2021
CN 112538111 A 3/2021
CN 112552399 A 3/2021
CN 112574299 A 3/2021
CN 112574300 A 3/2021
CN 112625125 A 4/2021
CN 112625136 A 4/2021
CN 112626030 A 4/2021
CN 112626089 A 4/2021
CN 112646005 A 4/2021
CN 112661841 A 4/2021
CN 112724247 A 4/2021
CN 112724248 A 4/2021
CN 112794898 A 5/2021
CN 112794899 A 5/2021
CN 112851804 A 5/2021
CN 112980885 A 6/2021
CN 113045647 A 6/2021
CN 113072640 A 7/2021
CN 113150129 A 7/2021
CN 113150130 A 7/2021
CN 113150132 A 7/2021
CN 113150135 A 7/2021
CN 113151184 A 7/2021
CN 113173995 A 7/2021
CN 113185609 A 7/2021
CN 113214389 A 8/2021
CN 113215106 A 8/2021
CN 113234148 A 8/2021
CN 113234149 A 8/2021
CN 113234150 A 8/2021
CN 113234151 A 8/2021
CN 113248579 A 8/2021
CN 113248581 A 8/2021
CN 113264998 A 8/2021
CN 113292649 A 8/2021
CN 113292650 A 8/2021
CN 113307865 A 8/2021
CN 113336846 A 9/2021
CN 113354731 A 9/2021
CN 113354733 A 9/2021
DE 202020105116 11/2020
EP 3872091 A1 9/2021
EP 3885361 A1 9/2021
KR 102205028 B1 1/2021
KR 102229225 B1 3/2021
KR 102233689 B1 3/2021
RU 2744274 C1 3/2021
WO 05/018535 A2 3/2005
WO 05/060520 A2 7/2005
WO 2005-118644 A2 12/2005
WO 08/068048 A2 6/2008
WO 2015/179535 A1 11/2015

(56) References Cited

FOREIGN PATENT DOCUMENTS

| | | | | |
|---|---|---|---|---|
| WO | 2016-123019 | A1 | 8/2016 | |
| WO | 2019/147831 | A1 | 8/2019 | |
| WO | 21/001388 | A1 | 1/2021 | |
| WO | 21/026074 | A1 | 2/2021 | |
| WO | 21/035177 | A2 | 2/2021 | |
| WO | 21/045836 | A1 | 3/2021 | |
| WO | WO-2021045836 | A1 * | 3/2021 | ............. A61K 39/15 |
| WO | 21/058521 | A1 | 4/2021 | |
| WO | 21/072399 | A1 | 4/2021 | |
| WO | 21/096980 | A1 | 5/2021 | |
| WO | 21/148884 | A1 | 7/2021 | |
| WO | 21/151100 | A1 | 7/2021 | |
| WO | 21/155639 | A1 | 8/2021 | |
| WO | 21/163265 | A1 | 8/2021 | |
| WO | 21/168483 | A2 | 8/2021 | |
| WO | 21/173879 | A1 | 9/2021 | |
| WO | 21/180602 | A1 | 9/2021 | |
| WO | 21/183790 | A1 | 9/2021 | |
| WO | 2021/183195 | A1 | 9/2021 | |
| WO | 2021/183359 | A1 | 9/2021 | |
| WO | 2021/190980 | A1 | 9/2021 | |
| WO | 2021/203053 | A1 | 10/2021 | |
| WO | 2021/222935 | A2 | 11/2021 | |
| WO | 2021/226560 | A1 | 11/2021 | |
| WO | 2021/233834 | A1 | 11/2021 | |
| WO | 21/242815 | A1 | 12/2021 | |
| WO | 21/247779 | A1 | 12/2021 | |
| WO | 2021/239935 | A1 | 12/2021 | |
| WO | 2021/245184 | A1 | 12/2021 | |
| WO | 2021/249547 | A1 | 12/2021 | |
| WO | 2022/090353 | A1 | 5/2022 | |
| WO | 2022/162587 | A1 | 8/2022 | |

OTHER PUBLICATIONS

Chen et al., "Enhancement and destruction of antibody function by somatic mutation unequal occurrence is controlled by V gene combinatorial associations," The EMBO Journal, vol. 14 (No. 12): 2784-2794, (1995).

Koenig et al., "Mutational landscape of antibody variable domains reveals a switch modulating the interdomain conformational dynamics and antigen binding," PNAS, E486-E495, (2017). [www.pnas.org/cgi/doi/10.1073/pnas.1613231114].

Martinez-Navio et al., "Long-Term Delivery of an Anti-SIV Monoclonal Antibody With AAV," Frontiers in Immunology, vol. 11(Article 449): 1-9, (Mar. 2020). [doi: 10.3389/fimmu.2020.00449].

U.S. Appl. No. 17/337,396, Final Office Action mailed Oct. 4, 2023.

U.S. Appl. No. 17/337,396, Notice of Allowance mailed Jan. 29, 2024.

U.S. Appl. No. 18/216,118, Non-Final Office Action mailed Apr. 16, 2024.

U.S. Appl. No. 17/863,864, Requirement for Restriction/Election mailed Jun. 28, 2024.

U.S. Appl. No. 18/216,118, Non-Final Office Action mailed Aug. 2, 2024.

U.S. Appl. No. 17/863,864, Non-Final Office Action mailed Oct. 9, 2024.

U.S. Appl. No. 18/216,118, Notice of Allowance mailed Nov. 19, 2024.

Zhao et al., "Isolation and identification of an scFv antibody against nucleocapsid protein of SARS-CoV," Microbes and Infection 9 (2007) 1026-1033. [doi:10.1016/j.micinf.2007.04.008].

Andreano et al., "Identification of neutralizing human monoclonal antibodies from Italian Covid-19 convalescent patients," bioRxiv 2020.05.05.078154; (2020) doi: https://doi.org/10.1101/2020.05.05.078154.

Almagro et al., "Humanization of Antibodies," Frontiers in Bioscience, vol. (13): 1619-1633, (2008).

Barnes et al., "Structures of human antibodies bound to SARS-CoV-2 spike reveal common epitopes and recurrent features of antibodies," Structures of human antibodies bound to SARS-CoV-2 spike reveal common epitopes and recurrent features of antibodies, Cell (2020), doi: https://doi.org/10.1016/j.cell.2020.06.025.

Barnes et al., "Structures of Human Antibodies Bound to SARS-CoV-2 Spike Reveal Common Epitopes and Recurrent Features of Antibodies," Cell, vol. (182, Issue 4): 828-842, Jun. 23, 2020 (2020).

Barnes et al., "SARS-CoV-2 neutralizing antibody structures inform therapeutic strategies," Nature, vol. 588, No. 7839, pp. 682-687, (2020). [Retrieved from the Internet: <URL: http://www.nature.com/articles/s41586-020-2852-1>].

Baum et al., "REGN-CoV2 antibodies prevent and treat SARS-CoV-2 infection in rhesus macaques and hamsters," Science, vol. 370, No. 6520:1110-1115, (2020).

Baum A, Copin R, Ajithdoss D, et al. REGN-COV2 antibody cocktail prevents and treats SARS-CoV-2 infection in rhesus macaques and hamsters. bioRxiv 2020:2020.08.02.233320.

Baum et al., "Antibody cocktail to SARS-CoV-2 spike protein prevens rapid mutational escape seen with individual antibodies," Science, pp. 1-8, (Jun. 15, 2020). [Retrieved from the Internet Jun. 23, 2020 from http://science.sciencemag.org/].

Baum A, Fulton BO, Wloga E, et al. Antibody cocktail to SARS-CoV-2 spike protein prevents rapid mutational escape seen with individual antibodies. Science 2020.

Baum et al., "Antibody cocktail to SARS-CoV-2 spike protein prevents rapid mutational escape seen with individual antibodies," Science, vol. (1):1-17, (2020). [Retrieved from the Internet Jun. 30, 2020: <URL: http://science.sciencemag.org].

Bertoglio et al., "SARS-CoV-2 neutralizing human recombinant antibodies selected from pre-pandemic healthy donors binding at RBD-ACE2 interface," bioRxiv 2020.06.05.135921; (2020) doi: https://doi.org/10.1101/2020.06.05.135921.

Blanco-Melo D, Nilsson-Payant BE, Liu WC, et al. Imbalanced Host Response to SARS-CoV-2 Drives Development of COVID-19. Cell 2020;181:1036-45 e9.

Brouwer et al., "Potent neutralizing antibodies from COVID-19 patients define multiple targets of vulnerability" Science 10.1126/Science.abc5902 (2020).

Brouwer et al., "Potent neutralizing antibodies from COVID-19 patients define multiple targets of vulnerability" bioRxiv 2020.05.12.088716; doi: https://doi.org/10.1101/2020.05.12.088716.

Brouwer et al., "Potent neutralizing antibodies from COVID-19 patients define multiple targets of vulnerability," bioRxiv 2020.05.12.088716; (2020) doi: https://doi.org/10.1101/2020.05.12.088716.

Bruel et al., "Serum neutralization of SARS-COV-2 Omicron sublineages BA.1 and BA.2 in patients receiving monoclonal antibodies," Nature Medicine, Nature Publishing Group US, vol. (28) No. 6: 1297-1302, (2022). [Retrieved from the Internet Mar. 23, 2022; ISSN: 1078-8956, DOI:10.1038/S41591-022-01792-5].

Cao et al., "Potent Neutralizing Antibodies against SARS-CoV-2 identified by high-throughput single-cell sequencing of convalescent patients' B cells," Cell (2020), doi: https://doi.org/10.1016/j.cell.2020.05.025.

Cao et al., "Potent Neurtalizing Antibodies against SARS-CoV-2 Identified by High-Throughput Single-Cell Sequencing of Convalescent Pateitns'B Cells," Cell, vol. (182): 73-84, (2020). [https://doi.org/10.1016/j.cell.2020.05.025].

Case et al., "Neutralizing antibody and soluble ACE2 inhibition of a replication-competent VSV-SARS-CoV-2 and a clinical isolate of SARS-CoV-2," bioRxiv 2020.05.18.102038; (2020) doi: https://doi.org/10.1101/2020.05.18.102038.

Chen et al., "Human monoclonal antibodies block the binding of SARS-CoV-2 spike protein to angiotensin converting enzyme 2 receptor," Cellular & Molecular Immunology (2020) https://doi.org/10.1038/s41423-020-0426-7.

Chen et al., "Resistance of SARS-CoV-2 variants to neutralization by monoclonal and serum-derived polyclonal antibodies," Nature Medicine, vol. (27): 717-726, (2021). [https://doi.org/10.1038/s41591-021-01294-w].

Cheng et al., "Impact of South African 501.V2 Variant on SARS-CoV-2 Spike Infectivity and Neutrlization: A Structure-based Computational Assessment," Bioinformatics, pp. 1-7, (2021). [https://doi.org/10.1101/2021.01.10.426143].

(56) References Cited

OTHER PUBLICATIONS

Cheng et al., "An insertion unique to SARS-CoV-2 exhibits superantigenic character strengthened by recent mutations," bioRxiv 2020.05.21.109272; (2020) doi: https://doi.org/10.1101/2020.05.21.109272.
Chi et al., "A neutralizing human antibody binds to the N-terminal domain of the Spike protein of SARS-CoV-2," Science 11.1126/science.abc6952 (2020).
Chi et al., "A potent neutralizing human antibody reveals the N-terminal domain in the Spike protein of SARS-CoV-2 as a site of vulnerability," bioRxiv 2020.05.08.083964; (2020) doi: https://doi.org/10.1101/2020.05.08.083964.
Chi et al., "Humanized Single Domain Antibodies Neutralize SARS-CoV-2 by Targeting Spike Receptor Binding Domain," bioRxiv 2020.04.14.042010; (2020) doi: https://doi.org/10.1101/2020.04.14.042010.
Choi et al., "Characterization of a human monoclonal antibody generated from a B-cell specific for a prefusion-stabilized spike protein of Middle East respiratory syndrome coronavirus," PLoS One 15(5): e0232757. https://doi.org/10.1371/journal.pone.0232757.
Choudhury et al., "In silico studies on the comparative characterization of the interactions of SARS-CoV-2 spike glycoprotein with ACE-2 receptor homologs and humans TLRs," (2020) doi: 10.1002/jmv.25987.
Crooke et al., "Immunoinformatic identification of B cell and T cell epitopes in the SARS-CoV-2 proteome," bioRxiv 2020.05.14.093757; (2020) doi: https://doi.org/10.1101/2020.05.14.093757.
Custodio et al., "Selection, biophysical and structural analysis of synthetic nanobodies that effectively neutralize SARS-CoV-2," bioRxiv 2020.06.23.165415; (2020) doi: https://doi.org/10.1101/2020.06.23.165415.
Coronavirus Disease 2019 (COVID-19) Situation Report—101. 2020. (Accessed Oct. 6, 2020, at https://www.who.int/docs/default-source/coronaviruse/situation-reports/20200430-sitrep-101-covid-19.pdf?sfvrsn=2ba4e093_2.).
Copin et al., "The monoclonal antibody combination REGEN-COV protects against SARS-CoV-2 mutational escape in preclinical and human studies" Cell, vol. (184): 3949-3961, (Jul. 22, 2021). [https://doi.org/10.1016/j.cell.2021.06.002].
Davidson et al., "Mechanism of Binding to Ebola Virus Glycoprotein by the ZMapp, ZMAb, and MB-003 Cocktail Antibodies," Journal of Virology, vol. (89.21): 10982-10992, (2015).
Deeks et al., "Casirivimab/Imdevimab: First Approval," Drugs, vol. (81) No. 17: 2047-2055, (2021). [URL: https://link.springer.com/article/10.1007/s40265-021-01620-z/fulltext.html].
Deshpande et al., "Epitope Classification and RBD Binding Properties of Neutralizing Antibodies Against SARS-CoV-2 Variants of Concern," Frontiers in Immunology, vol. 12, Jun. 4, 2021; 30 pages.
Dinnon, III et al., "A mouse-adapter SARS-CoV-2 model for the evaluation of COVID-19 medical countermeasures," bioRxiv 2020.05.06.081497; (2020) doi: https://doi.org/10.1101/2020.05.06.081497.
Dong et al., "Development of multi-specific humanized llama antibodies blocking SARS-CoV-2/ACE2 interaction with high affinity and avidity," Emerging Microbes & Infections, 9:1, 1034-1036, DOI: 10.1080/22221751.2020.1768806.
Edwards et al., "The Remarkable Flexibility of the Human Antibody Repertoire; Isolation of Over One Thousand Different Anibodies to a Single Protein, BLyS,"JMB, vol. (334): 103-118, (2003). [doi:10.1016/jmb.2003.09.054>].
European Medicines Agency (EMA), "Assesment report Regeneron Ireland DAC use of casirivimab and imdevimab for the treatment of COVID-19," Chapter 2.2, (2021). [Retrieved from the Internet URL:https://www.ema.europa.eu/en/documents/referral/regn-cov2-antibody-combination-casirivimab/imdevimab-covid19-article-53-procedure-assessment-report_en.pdf].
Ejemel et al., "IgA Mab blocks SARS-CoV-2 Spike-ACE2 interaction providing mucosal immunity," bioRxiv 2020.05.15.096719; doi: https://doi.org/10.1101/2020.05.15.096719.
Galson et al., "Deep sequencing of B cell receptor repertoires from COVID-19 patients reveal strong convergent immune signature," bioRxiv 2020.05.20.106294; doi: https://doi.org/10.1101/2020.05.20.106294.
Garde et al., "In the race to develop a coronavirus treatment, Regeneron thinks it has the inside track," STAT, pp. 1-7, Feb. 5, 2020 (2020). [https://www.statnews.com/2020/02/05/in-the-race-to-develop-a-coronavirus-treatment-regeneron-thinks-it-has-the-inside-track/].
Giron et al., "On the Interactions of the receptor-binging domain of SARS-CoV-1 and SARS-CoV-2 spike proteins with monoclonal antibodies and the receptor ACE2," Virus Research 285 (2020) 198021.
Goncalves et al., "SARS-CoV-2 mutations and where to find them: An in silico perspective of structural changes and antigenicity of the Spike protein," bioRxiv 2020.05.21.108563; (2020) doi: https://doi.org/10.1101/2020.05.21.108563.
Goyal P, Choi JJ, Pinheiro LC, et al. Clinical Characteristics of Covid-19 in New York City. N Engl J Med 2020.
Grifoni et al., "Targets of T cell responses to SARS-CoV-2 coronavirus in humans with COVID-19 disease and unexposed individuals," Cell (2020), doi: https://doi.org/10.1016/j.cell.2020.05.015.
Group RC, Horby P, Lim WS, et al. Dexamethasone in Hospitalized Patients with Covid-19—Preliminary Report. N Engl J Med 2020.
Guan WJ, Ni ZY, Hu Y, et al. Clinical Characteristics of Coronavirus Disease 2019 in China. N Engl J Med 2020;382:1708-20.
Gudbjartsson DF, Helgason A, Jonsson H, et al. Spread of SARS-CoV-2 in the Icelandic Population. N Engl J Med 2020;382:2302-15.
Hanke et al., "An alpaca nanobody neutralizes SARS-CoV-2 by blocking receptor interaction," bioRxiv 2020.06.02.130161; (2020) doi: https://doi.org/10.1101/2020.06.02.130161.
Hansen et al., "Studies in humanized mice and convalescent humans yield a SARS-CoV-2 antibody cocktail," Science, vol. (1):1-47, (2020). [Retrieved from the Internet Jun. 30, 2020: <URL: http://science.sciencemag.org].
Hansen et al., "Studies in humanized mice and convalescent humans yield a SARS-CoV-2 antibody cocktail," Science, 1-10, (2020). [Retrieved from the Internet Jul. 29, 2020: <http://science.sciencemag.org>].
Hansen et al., "Studies in humanized mice and convalescent humans yield a SARS-CoV-2 antibody cocktail," Science, pp. 1-10, (Jun. 15, 2020). [Retrieved from the Internet Jun. 23, 2020 from http://science.sciencemag.org/].
Hansen et al.,supplementary materials for "Studies in humanized mice and convalescent humans yield a SARS-CoV-2 antibody cocktail," Science, pp. 1-30, (Jun. 15, 2020). [science.scieocemag.org/cgi/conrent/fu1Vscience.abd0827/DCJ].
Hansen J, Baum A, Pascal KE, et al. Studies in humanized mice and convalescent humans yield a SARS-CoV-2 antibody cocktail. Science 2020.
Heurich et al., "TMPRSS2 and ADAM17 Cleave ACE2 Differentially and Only Proteolysis by TMPRSS2 Augments Entry Driven by the Severe Acute Respiratory Syndrome Coronavirus Spike Protein," Journal of Virology, vol. 88, No. 2; Jan. 2014; p. 1293-1307.
Hsieh et al., "Structure-based design of prefusion-stabilized SARS-CoV-2 Spikes," bioRxiv 2020.05.30.125484; (2020) doi: https://doi.org/10.1101/2020.05.30.125484.
Huibin et al., "Cross-reactive Antibody Response between SARS-CoV-2 and SARS-CoV Infections," Cell Reports 31, 107725; Jun. 2, 2020. https://doi.org/10.1016/j.celrep.2020.107725.
Hulburt et al., "Structural basis for potent neurtralization of SARS-CoV-2 and role of antibody affinity maturation," bioRxiv 2020.06.12.148692; doi: https://doi.org/10.1101/2020.06.12.148692.
Huo et al., "Neutralization of SARS-CoV-2 by destruction of the prefusion Spike," bioRxiv 2020.05.05.079202; (2020) doi: https://doi.org/10.1101/2020.05.05.079202.
Jacobs et al., "Neutralizing antibodies mediate virus-immune pathology of COVID-19," Science Direct, Medical Hypotheses 143; 109884, pp. 1-4. (2020).
Ju et al., "Human neutralizing antibodies elicited by SARS-CoV-2 infection," Nature https://doi.org/10.1038/s41586-020-2380-z (2020).

(56) References Cited

OTHER PUBLICATIONS

Ju et al., "Potent human neutralizing antibodies elicited by SARS-CoV-2 infection," bioRxiv 2020.03.21.990770; (2020) doi: https://doi.org/10.1101/2020.03.21.990770.

Keeffe et al., "A Combination of Two Human Monoclonal Antibodies Prevents Zika Virus Escape Mutations in Non-human Primates," Cell Reports, vol. (25): 1385-1394, (2018). [https://doi.org/10.1016/j.celrep.2018.10.031].

Kreer et al., "Longitudinal isolation of potent near-germline SARS-CoV-2-neutralizing antibodies from COVID-19 patients," bioRxiv 2020.06.12.146290; doi: https://doi.org/10.1101/2020.06.12.146290.

Kugel Man et al., "Emergence of Ebola Virus Escape Variants in Infected Nonhuman Primates Treated with the MB-003 Antibody Cocktail," Cell Reports, vol. (12): 2111-2120, (2015). [http://dx.doi.org/10.1016/j.celrep.2015.08.038].

Kussie et al., "A Single engineered amino acid substitution changes antibody fine specificity," The Journal of Immunology, vol. (152) 1: 146-152, (1994). [https://doi:org/10.4049/jimmunol.152.1.146].

Interim Clinical Guidance for Management of Patients with Confirmed Coronavirus Disease (COVID-19)—Clinical Care Guidance—Updated Sep. 10, 2020. 2020. (Accessed Oct. 6, 2020).

Joyner MJ, Senefeld JW, Klassen SA, et al. Effect of Convalescent Plasma on Mortality among Hospitalized Patients with COVID-19: Initial Three-Month Experience. medRxiv 2020:2020.08.12.20169359.

Jones et al., "LY-CoV555, a rapidly isolated potent neutralizing antibody, provides protection in a non-human primate model of SARS-CoV-2 infection," bioRxiv, Oct. 9, 2020; 29 pages. [Retrieved from the Internet May 23, 2021: <URL: http://www.biorxiv.org/content/10.1101/2020.09.30.318972x3>].

Lagadinou et al., "Prognosis of COVID-19: Changes in laboratory parameters," Le Infezioni in Medicina, Suppl. 1, p. 89-95 (2020).

Lan et al., "Structure of the SARS-CoV-2 spike receptor-binding domain bound to the ACE2 receptor," Nature, vol. 581, May 14, 2020.

Larsen et al., "Afucosylated immunoglobulin G resposnes are a hallmark of enveloped virus infections and show an exacerbated phenotype in COVID-19," bioRxiv 2020.05.18.099507; doi: https://doi.org/10.1101/2020.05.18.099507.

Lavezzo E, Franchin E, Ciavarella C, et al. Suppression of a SARS-CoV-2 outbreak in the Italian municipality of Vo'. Nature 2020;584:425-9.

Lee et al., "CD-8+ T cell cross-reactivity against SARS-CoV-2 conferred by toerh coronavirus strains and influenza virus," bioRxiv 2020.05.20.107292; doi: https://doi.org/10.1101/2020.05.20.107292.

Lee S, Kim T, Lee E, et al. Clinical Course and Molecular Viral Shedding Among Asymptomatic and Symptomatic Patients With SARS-CoV-2 Infection in a Community Treatment Center in the Republic of Korea. JAMA Intern Med 2020.

Li et al., "Potent neutralization of SARS-CoV-2 in vitro and in an animal model by a human monoclonal antibody," bioRxiv 2020.05.13.093088; doi: https://doi.org/10.1101/2020.05.13.093088.

Li et al., "Potent synthetic nanobodies against SARS-CoV-2 and molecular basis for neutralization," bioRxiv 2020.06.09.143438; doi: https://doi.org/10.1101/2020.06.09.143438.

Li L, Zhang W, Hu Y, et al. Effect of Convalescent Plasma Therapy on Time to Clinical Improvement in Patients With Severe and Life-threatening COVID-19: A Randomized Clinical Trial. JAMA 2020;324:460-70.

Li et al., "Repurposing host-based therapeutics to control coronavirus and influenza virus," Drug Discovery Today, vol. 24 (No. 3): 726-736, (Mar. 2019). [https://doi.org/10.1016/j.drudis.2019.01.018].

Lou et al., "Cross-neutralization antibodies against SARS-cOv-2 and RBD mutations from convalescent patient antibody libraries," bioRxiv 2020.06.06.137513; doi: https://doi.org/10.1101/2020.06.06.137513.

Lui et al., "Trimeric SARS-CoV-2 Spike interacts with dimeric ACE2 with limited intra-Spike avidity," bioRxiv 2020.05.21.109157; doi: https://doi.org/10.1101/2020.05.21.109157.

Lotfi et al., "covid-19: Transmission, prevention, and potential therapeutic opportunities," Science Direct, Clinica Chimica Acta (508): 254-266, (2020).

Lv et al., "Structural basis for neutralization of SARS-CoV-2 and SARS-CoV by a potent therapeutic antibody," bioRxiv 2020.06.02.129098; doi: https://doi.org/10.1101/2020.06.02.129098.

Magleby R, Westblade LF, Trzebucki A, et al. Impact of SARS-CoV-2 Viral Load on Risk of Intubation and Mortality Among Hospitalized Patients with Coronavirus Disease 2019. Clin Infect Dis 2020.

Matsuyama et al., "Enhanced isolation of SARS-CoV-2 by TMPRSS2-expressing cells," PNAS, vol. 117 (No. 13), pp. 7001-7003, (Mar. 31, 2020). [<www.pnas.org/cgi/doi/10.1073/pnas.2002589117>].

Mazzaferri et al., "Exploratory data on the clinical efficacy of monoclonal antibodies against SARS-DOV-2 Omicron Variant of Concern," medRxiv, pp. 1-21, (2022). [Retrieved from the Internet Jun. 27, 2022: <URL: http://www.medrxiv.org/content/10.1101/2022.05.06.22274613v1>].

Meirson et al., "Structural basis of SARS-COV-2 spike protein induced by ACE2," bioRxiv 2020.05.24.113175; doi: https://doi.org/10.1101/2020.05.24.113175.

Meulen et al., "Human Monoclonal Antibody Combination against SARS Coronavirus: Synergy and Coverage of Escape Mutants," PLoS Medicine, vol. (3.7): 1071-1079, (2006). [www.plosmedicine.org].

Miersch et al., "Synthetic Antibodies neutralized SARS-CoV-2 infection of mammalian cells," bioRxiv 2020.06.05.137349; doi: https://doi.org/10.1101/2020.06.05.137349.

Mossel et al., "Exogenous ACE2 Expression Allows Refractory Cell Lines to Support Severe Acute Respiratory Syndrome Coronavirus Replication," Journal of Virology, vol. 79, No. 6; Mar. 2005; pp. 3846-3850.

Nascimento Jr. et al., "SARS, MERS and SARS-CoV-2 (COVI19) treatment: a patent review," Expert Opinion on Therapeutic Patents, DOI: 10.1080/13543776.2020.1772231.

Ng et al., "Pre-existing and de novo humoral immunity to SARS-CoV-2 in humans," bioRxiv 2020.05.14.095414; doi: https://doi.org/10.1101/2020.05.14.095414.

Ni et al., "Detection of SARS-CoV-2-Specific Humoral and Cellular Immunity in COVID-19 Convalescent Individuals," Immunity 52, 1-7; Jun. 16, 2020.

Nieto et al., "Fast isolation of sub-nanomolar affinity alpaca nanobody against the Spike RBD of SARSCoV-2 by combining bacterial display and a simple single-step density gradient selection," bioRxiv, vol. (1):1-27, (2020). [https://doi.org/10.1101/2020.06.09.137935].

Noy-Porat et al., "Tiger team: a panel of human neutralizing mAbs targeting SARS-CoV-2 spike at multiple epitopes," bioRxiv 2020.05.20.106609;.

Okba et al., "Severe Acute Respiratory Syndrome Coronavirus 2-Specific Antibody Responses in Coronavirus Disease 2019 Patients," Research vol. 26, No. 7; Apr. 8, 2020.

Oran DP, Topol EJ. Prevalence of Asymptomatic SARS-CoV-2 Infection : A Narrative Review. Ann Intern Med 2020;173:362-7.

Park et al., "Spike protein binding prediction with neutralizing antibodies of SARS-CoV-2", bioRxiv 2020.02.22.951178; (2020) doi: https://doi.org/10.1101/2020.02.22.951178.

Pascal et al., "Pre- and postexposure efficacy of fully human antibodies against Spike protein in a novel humanized mouse model of MERS-CoV infection," PNAS, vol. (112 No. 28): 8738-8743, (2015). [www.pnas.org/cgi/doi/10.1073/pnas.1510830112].

Pascal et al., "Development of Clinical-Stage Human Monoclonal Antibodies That Treat Advanced Ebola Virus Disease in Nonhuman Primates," The Journal of Infectious Diseases, vol. (218): S612-S626, (2018).

Pinto et al., "Cross-neutralization of SARS-CoV-2 by a human monoclonal SARS-CoV antibody," Nature https://doi.org/10.1038/s41586-020-2349-y (2020).

Pinto et al., "Cross-neutralization of SARS-CoV-2 by a human monoclonal SARS-CoV antibody," Nature, vol. (583): 290-308, (2020). [https://doi.org/10.1038/s41586-020-2 349-y].

(56) References Cited

OTHER PUBLICATIONS

Poh et al., "Two linear epitopes on the SARS-CoV-2 spike protein that elicit neutralising antibodies in COVID-19 patients," Nature Communications (2020)11:2806. https://doi.org/10.1038s41467-020-16638-2.

Qiang et al., "Monoclonal Antibodies Capable of Binding SARS-CoV-2 Spike Protein Receptor Binding Motif Specifically Prevent GM-CSF Induction," bioRxiv, pp. 1-27, Sep. 4, 2020 (2020).

Ravichandran et al., "Antibody repertoire induced by SARS-CoV-2 spike protein immunogens," bioRxiv 2020.05.12.091918; doi: https://doi.org/10.1101/2020.05.12.091918.

Raybould et al., "CoV-AbDab: the Coronavirus Antibody Database," bioRxiv 2020.05.15.077313; doi: https://doi.org/10.1101/2020.05.15.077313.

Reichert, "Coronavirus in the crosshairs, Part 1—The Antibody Society," pp. 1-7, (2020). [https://www.antibodysociety.org/coronavirus/coronavirus-in-the-crosshairs/].

Reichert, "Coronavirus in the crosshairs, Part 4: Antibody therapeutics—The Antibody Society," pp. 1-10, (2020). [https://www.antibodysociety.org/covid-19/coronavirus-in-the-crosshairs-part-4-antibody-therapeutics/].

Regeneron. Regeneron and Sanofi Provide Update On Kevzara (Sarilumab) Phase 3 U.S. Trial in COVID-19 Patients. 2020.

Richardson S, Hirsch JS, Narasimhan M, et al. Presenting Characteristics, Comorbidities, and Outcomes Among 5700 Patients Hospitalized With COVID-19 in the New York City Area. JAMA 2020.

Robbiani et al., "Convergent antibody responses to SARS-CoV-2 in convalescent individuals," Nature https://doi.org/10.1038/s41586-020-2456-9 (2020).

Robbiani et al., "Convergent Antibody Responses to SARS-CoV-2 Infection in Convalescent Individuals," bioRxiv 2020.05.13.092619; (2020) doi: https://doi.org/10.1101/2020.05.13.092619.

Rouet et al., "Potent SARS-CoV-2 binding and neutralization through maturation of iconic SARS-CoV-1 antibodies," bioRxiv, pp. 1-52, (2020). [https://doi.org/10.1101/2020.12.14.422791].

Roche. Roche Provides an Update on the Phase III Covacta Trial of ACTEMRA/ROACTEMRA in Hospitalized Patients with Severe COVID-19 Associated Pneumonia. 2020.

Rockx et al., "Escape from Human Monoclonal Antibody Neutralization Affects in Vitro and In Vivo Fitness of Severe Acute Respiratory Syndrome Coronavirus," The Journal of Infectious Diseases, vol. (201): 946-955, (2010). [DOI: 10.1086/651022].

Rogers et al., "Isolation of potent SARS-CoV-2 neutralizing antibodies and protection from disease in a small animal model," Science 10.1126/scienec.abc7520 (2020).

Rogers et al., "Rapid isolation of potent SARS-CoV-2 neutralizing antibodies and protection in a small animal model," bioRxiv 2020.05.11.088674; doi: https://doi.org/10.1101/2020.05.11.088674.

Rudikoff et al., "Single amino acid substitution altering antigen-binding specificity," Proc. Natl. Acad. Sci. USA, vol. 79:1979-1983, (Mar. 1982).

Rosas I, Bräu N, Waters M, et al. Tocilizumab in Hospitalized Patients With COVID-19 Pneumonia. medRxiv 2020:2020.08.27.20183442.

Seydoux et al., "Analysis of a SARS-CoV-2 infected individual reveals development of potent neutralizing antibodies to distinct epitopes with limited somatic mutation ," Immunity 4384; https://doi.org/10.1016/j.immuni.2020.06.001.

Seydoux et al., "Characterization of neutralizing antibodies from a SARS-CoV-2 infected individual," bioRxiv 2020.05.12.091298; doi: https://doi.org/10.1101/2020.05.12.091298.

Shi et al., "A Human neutralizing antibody targets the receptor binding cite of SARS-CoV-2," Nature https://doi.org/10.1038/s41586-020-2381-y (2020).

Simoes EAF, Forleo-Neto E, Geba GP, et al. Suptavumab for the Prevention of Medically Attended Respiratory Syncytial Virus Infection in Preterm Infants. Clin Infect Dis 2020.

Suthar et al., "Rapid generation of neutralizing antibody responses in COVID-19 patients," Cell Reports Medicine, 1-36 pages (2020). [https://doi.org/10.1016/j.xcrm.2020.100040].

Stave et al., "Antibody and Antigen Contact Residues Define Epitope and Paratope Size and Structure," The Journal of Immunology, vol. (191): 1428-1435, (2013). [www.jimmunol.org/cgi/doi/10.4049/jimmunol.1203198].

Supasa et al., "Reduced neutralization of SARS-CoV-2 B.1.1.7 variant by convalescent and vaccine sera," Cell, vol. (184): 2201-2211, (2021). Https://doi.org/10.1016/j.cell.2021.02.033].

Tai et al., "Identification of SARS-CoV RBD-targeting monoclonal antibodies with crossreactive or neutralizing activity against SARS-CoV-2," Antiviral Research, Science Direct, vol.(179):1-6, (2020). [www.elsevier.com/locate/antiviral].

Tatham et al., "Lack of Ronapreve (REGN-COV;casirivimab and imdevimab) virological efficacy against the SARS-COV-2 Omicron variant (B.1.1.529) in K18-hACE2 mice," bioRxiv, (2022). [Retrieved from the Internet Feb. 14, 2023 URL:https://www.biorxiv.org/content/10.1101.2022.01.23.477397v1].

Teng et al., "Systemic Effects of Missense Mutations on SARS-CoV-2 Spike Glycoprotein Stability and Receptor Binding Affinity," bioRxiv, vol. (1):1-36, (2020). [https://doi.org/10.1101/2020.05.21.109835].

Tenforde MW, Kim SS, Christopher J. Lindsell, et al. Symptom Duration and Risk Factors for Delayed Return to Usual Health Among Outpatients with COVID-19 in a Multistate Health Care Systems Network—United States, Mar.-Jun. 2020. MMWR Morb Mortal Wkly Rep 2020;60:993-8.

Tian et al., "Potent binding of 2019 novel coronavirus spike protein by a SARS coronavirus-specific human monoclonal antibody," Emerging Microbes & Infections, vol. (17): 647-649, Feb. 17, 2020 (2020).

Tortorici et al., "Ultrapotent human antobodies protect against SARS-CoV-2 challenge via multiple mechanisms," Science, vol. 370:950-957, (2020). [Retrieved from the Internet Apr. 14, 2021: <URL: http://www.science.sciencemag.org/content/sci/370/6519/950.full.pdf>].

U.S. Appl. No. 16/912,678, Notice of Allowance mailed Jul. 29, 2020.

U.S. Appl. No. 16/996,297, Non-Final Office Action mailed Dec. 8, 2020.

U.S. Appl. No. 17/021,286, Non-Final Office Action mailed Dec. 23, 2020.

U.S. Appl. No. 17/021,286, Notice of Allowance mailed Jan. 22, 2021.

U.S. Appl. No. 16/996,297, Notice of Allowance mailed Jan. 25, 2021.

U.S. Appl. No. 17/207,524, Requirement for Restriction/Election mailed Sep. 7, 2022.

U.S. Appl. No. 17/207,524, Non-Final Office Action mailed Nov. 22, 2022.

U.S. Appl. No. 17/337,396, Non-Final Office Action mailed Nov. 14, 2022.

U.S. Appl. No. 17/207,524, Notice of Allowance mailed Mar. 30, 2023.

U.S. Appl. No. 17/337,396, Non-Final Office Action mailed Apr. 11, 2023.

Uraki et al., "Characterization and antiviral susceptibility of SARS-COV-2 Omicron BA.2," Nature, Nature Publishing Group UK, London, vol. (607) No. 7917: 119-127, (2022). [Retrieved from the Internet May 16, 2022, ISSN: 0028-0836, DOI: 10.1038/S41586-022-04856-1].

Van Blargan et al., "A potently neutralizing SARS-CoV-2 antibody inhibits variants of concern by utilizing unique binding residues in a highly conserved epitope," Immunity, vol. 54, No. 10, pp. 2399-2416, (2021).

Vandergaast et al., "Development and validation of IMMUNO-COVTM: a high-throughput clinical assay for detecting antibodies that neutralize SARS-CoV-2," bioRxiv, pp. 1-32, (2020). [https://doi.org/10.1101/2020.05.26.117549].

Walker et al., "Passive immunotherapy of viral infections: 'super-antibodies' enter the fray," Nature Reviews at Immunology, vol. 18: 297-308, (2018). [doi:10.1038/nri.2017.148].

Wang et al., "E484K mutation in SARS-CoV-2 RBD enahnces binding affinity with hACE2 but reduces interactions with neutral-

(56)        References Cited

OTHER PUBLICATIONS izing antibodies and nanobodies: Binding free energy calculation studies," bioRxiv, pp. 1-18, (2021).

Wan et al., "Human IgG cell neutralizing monoclonal antibodies block SARS-CoV-2 infect," bioRxiv, vol. (1):1-25, (2020). [https://doi.org/10.1101/2020.05.19.104117].

Wan et al., "Human IgG cell neutralizing monoclonal antibodies block SARS-CoV-2 infection," bioRxiv, pp. 1-28, (May 21, 2020). [doi:https://doi.org/10.1101/2020.05.19.104117].

Wang et al., "A human monoclonal antibody blocking SARS-CoV-2 infection," bioRxiv, pp. 1-24, (Mar. 12, 2020). [doi:https://doi.org/10.1101/2020.03.11.987958].

Wang et al., "A human monoclonal antibody blocking SARS-COV-2 infection," Supplemental information, 1-13 pages (2020).

Wang et al., "A human monoclonal antibody blocking SARS-CoV-2 infection," Nature Communications, 1-7, (2020). [https://doi.org/10.1038/s41467-020-16256-y | www.nature.com/naturecommunications].

Wang et al., "SARS-CoV-2 Neutralizing Antibody Responses Are More Robust in Patients with Severe Disease," bioRxiv, vol. (1):1-9, (2020). [https://doi.org/10.1101/2020.06.13.150250].

Wang et al., "Structural and Functional Basis of SARS-CoV-2 Entry by Using Human ACE2," Cell, vol. (181):894-904, (2020). [https://doi.org/10.1016/j.cell.2020.03.045].

Wang et al., "Evaluation of the efficacy and safety of intravenous remdesivir in adult patients with severe COVID-19: study protocol for a phase 3 randomized, double-blind, placebo-controlled, multicentre trial," Trials, vol. 21:422, 11 pages, (2020). DOI: https://doi.org/10.1186/s13063-020-04352-9.

Wang et al., "Importance of Neutralizing Monoclonal Antibodies Targeting Multiple Antigenic Sites on the Middle East Respiratory Syndrome Coronavirus Spike Glycoproein To Avoid Neutralization Escape," Vaccines and Antiviral Agents, Journal of Virology, vol. (92) No. (10): 1-21, ( May 2018). [Retrieved from the Internet May 5, 2020: <URL: http://jvi.asm.org>].

Watanabe et al., "Site-specific glycan analysis of the SARS-CoV-2 spike," Science, vol. (1):1-9, (2020). [Retrieved from the Internet May 13, 2020: <URL: http://science.sciencemag.org>; Y. Watanabe et al., Science 10.1126/science.abb9983 (2020)].

Watanabe et al., "Vulnerabilities in coronavirus glycan shields despite extensive glycosylation," Nature Communications, vol. (11):1-10, (2020). [https://doi.org/10.1038/s41467-020-16567-0].

Wec et al., "Broad neutralization of SARS-related viruses by human monoclonal antibodies," Science, vol. (1):1-12, (2020). [Retrieved from the Internet Jun. 17, 2020: <URL: http://science.sciencemag.org>; A. Z. Wec et al., Science 10.1126/science.abc7424 (2020)].

Wec et al., "Broad neutralization of SARS-related viruses by human monoclonal antibodies," Science, vol. (1):1-30, (2020). [science.sciencemag.org/cgi/content/full/science.abc7424/DC1>].

Wec et al., "Broad sarbecovirus neutralizing antibodies define a key site of vulnerability on the SARS-CoV-2 spike protein," bioRxiv, 1-18, (2020). [https://doi.org/10.1101/2020.05.15.096511].

Weinreich et al., "REGN-COV, a Neutralizing Antibody Cocktail, in Outpatients with Covid-19," The New England Journal of Medicine, vol. 384(3):238-251, (2020). [Retrieved from the Internet: <URL: http://www.nehm.org/doi/pds/10.1056/NEJMao2035002?articleTools=true>].

WHO Director-General's Opening Remarks at the Media Briefing on COVID-19—Mar. 11, 2020. 2020. (Accessed Jun. 9, 2020, at https://www.who.int/dg/speeches/detail/who-director-general-s-opening-remarks-at-the-media-briefing-on-covid-19---11-march-2020.).

Wiegang et al., "The Rise and Fall of SARS-COV-2 Variants and Ongoing Diversification of Omicron," Viruses, vol. (14) No. 9 : p. 2009, (2022). [URL: http://www.mdpi.com/1999-4915/14/9/20/09>].

WIPO Application No. PCT/US2020/039707, PCT International Search Report and Written Opinion of the International Searching Authority mailed Nov. 9, 2020.

WIPO Application No. PCT/US2021/035556, PCT International Search Report and Written Opinion of the International Searching Authority mailed Sep. 10, 2021.

WIPO Application No. PCT/US2021/034187, PCT International Search Report and Written Opinion of the International Searching Authority mailed Nov. 2, 2021.

WIPO Application No. PCT/US2020/039707, PCT Third Party Observation Communication mailed May 2, 2022.

WIPO Application No. PCT/US2022/018918, PCT International Search Report and Written Opinion of the International Searching Authority mailed Jun. 17, 2022.

WIPO Application No. PCT/US2022/036950, PCT International Search Report and Written Opinion of the International Searching Authority mailed Nov. 29, 2022; 30 pages.

WIPO Application No. PCT/US2022/036950, PCT Invitation to Pay Additional Fees, and Where Applicable, Protest Fee, mailed Oct. 7, 2022.

WIPO Application No. PCT/US2022/049069, PCT Invitation to Pay Additional Fees and, where Applicable, Protest Fee of the International Searching Authority mailed 03-02- 2023.

WIPO Application No. PCT/US2022/049069, PCT International Search Report and Written Opinion of the International Searching Authority mailed Apr. 26, 2023.

Wolfel R, Corman VM, Guggemos W, et al. Virological assessment of hospitalized patients with COVID-2019. Nature 2020;581:465-9.

Wrapp et al., "Structural Basis for Potent Neutralization of Betacoronaviruses by Single-Domain Camelid Antibodies," Cell, vol. (181):1-12, (2020). [https://doi.org/10.1016/j.cell.2020.04.031].

Wrapp et al., "Cryo-EM structure of the 2019-nCOV spike in the prefusion conformation," Science, vol. (367):1260-1263, (2020). [Retrieved from the Internet Jul. 29, 2020: <http://science.sciencemag.org>].

Wu et al., "A noncompeting pair of human neutralizing antibodies block COVID-19 virus binding to its receptor ACE2," Science, 1-8, (2020). [Retrieved from the Internet May 14, 2020: <URL: http://science.sciencemag.org>; Y. Wu et al., Science 10.1126/science.abc2241 (2020)].

Wu et al., "Fully human single-domain antibodies against SARS-CoV-2," bioRxiv 2020.03.30.015990; (2020) doi: https://doi.org/10.1101/2020.03.30.015990.

Wu et al., "Identification of Human Single-Domain Antibodies against SARS-CoV-2," Cell Host & Microbe, vol. (27):1-8, (2020). [https://doi.org/10.1016/j.chom.2020.04.023].

Wu et al., "Identification of Human Single-Domain Antibodies against SARS-CoV-2," Cell Host & Microbe, vol. (27):S 891-898, (2020).

Yi et al., "Key residues of the receptor binding motif in the spike protein of SARS-CoV-2 that interact with ACE2 and neutralizing antibodies," Cellular & Molecular Immunology, vol. (17): 621-630, (2020). [www.nature.com/cmi].

Yi et al., "Key residues of the receptor binding motif in the spike protein of SARS-CoV-2 that interact with ACE2 and neutralizing antibodies," Cellular & Molecular Immunology, 1-10, (2020).

Yu et al., "DNA vaccine protection against SARS-CoV-2 in rhesus macaques," Science, 1-11, (2020). [Retrieved from the Internet May 22, 2020: <URL: http://science.sciencemag.org>; J. Yu et al., Science 10.1126/science.abc6284 (2020)].

Yuan et al., "A highly conserved cryptic epitope in the receptor binding domains of SARS-CoV-2 and SARS-CoV," Science, vol. (368):630-633, (2020). [Retrieved from the Internet May 20, 2020: <URL: http://science.sciencemag.org>].

Yuan et al., "Isolation of and Characterization of Neutralizing Antibodies to Covid-19 from a Large Human Naïve scFv Phage Display Library," bioRxiv, 1-15, (2020). [https://doi.org/10.1101/2020.05.19.104281].

Yuan et al., "Structural and functional ramifications of antigenic drift in recent SARS-CoV-2 variants," bioRxiv, pp. 1-50, (2021). [https://doi.org/10.1101.2021.02.16.430500].

Zhang et al., "The use of anti-inflammatory drugs in the treatment of people with severe coronavirus disease 2019 (COVID-19): The

(56) References Cited

OTHER PUBLICATIONS

Perspectives of clinical immunologists from China," Clinical Immunology at ScienceDirect, vol. 214, (2020). [https://doi.org/10.1016/j.clim.2020.108393].
Zhang et al., "Immunization with the receptor-binding domain of SARS-CoV-2 elicits antibodies cross-neutralizing SARS-CoV-2 and SARS-CoV without antibody-dependent enhancement," bioRxiv, 1-33, (2020). [https://doi.org/10.1101/2020.05.21.107565].
Zheng et al., "Isolation of a human monoclonal antibody specific for the receptor binding domain of SARS-CoV-2 using a competitive phage biopanning strategy," Antibody Therapeutics, vol. (3.2):95-100, (2020). [Retrieved from the Internet May 27, 2020: <URL: https://academic.oup.com/abt/article-abstract/3/2/95/5827124>].
Zheng et al., "Novel antibody epitopes dominate the antigenicity of spike glycoprotein in SARS-CoV-2 compared to SARS-CoV," Cellular & Molecular Immunology, vol. (17):536-538, (2020). [https://doi.org/10.1038/s41423-020-0385-z].
Zhiqiang Ku et al., "Molecular determinants and mechanism for antibody cocktail preventing SARS-CoV-2 escape," Nature Communications, vol. 12(469), 13 pages (2021). [Retrieved from the Internet Apr. 14, 2022 <URL: http://www.nature.com.articles/s41467-020-20789-7.pdf>].
Zhu et al., "Safety, tolerability, and immunogenicity of a recombinant adenovirus type-5 vectored COVID-19 vaccine: a dose-escalation, open-label, non-randomised, first-in-human trial ," the lancet, vol. (395): 1845-1854, (May 22, 2020). [https://doi.org/10.1016/ 50140-6736(20)31208-3].
Zhou et al., "A pneumonia outbreak associated with a new coronavirus of probable bat origin," Nature, vol. (579): 270-289, (2020). [https://doi.org/10.1038/s41586-020-2012-7].
Zhou et al., "Evidence of escape of SARS-CoV-2 variant B.1.351 from natural and vaccine-induced sera," Cell, vol. (189): 2348-2361, (2021). [https://doi.org/10.1016/j.cell.2021.02.037].
Zost et al., "Potently neutralizing human antibodies that block SARS-CoV-2 receptor binding and protect animals," bioRxiv, 1-35, (2020). [https://doi.org/10.1101/2020.05.22.111005].
Zost et al., "Rapid isolation and profiling of a diverse panel of human monoclonal antibodies targeting the SARS-CoV-2 spike protein," bioRxiv, 1-48, (2020). [https://doi.org/10.1101/2020.05.12.091462].
European Patent Office issued Response to the Examination Report dated Nov. 17, 2021 for European Patent Application No. 16703030.3 mailed on Mar. 24, 2022, 6 pages.
Qiu et al., "Ebola GP-Specific Monoclonal Antibodies Protect Mice and Guinea Pigs from Lethal Ebola Virus Infection," PLOS Neglected Tropical Diseases, vol. 6(No. 3): e1575, pp. 1-8 (2012).
Qiu et al., "Successful Treatment of Ebola Virus-Infected Cynomolgus macaques with Monoclonal Antibodies," Science Translational Medicine, vol. 4(No. 138): 1-14, (Jun. 13, 2012).
Rayaprolu et al., "Structure of the Inmazeb cocktail and resistance to Ebola virus escape," Cell Host Microbe, vol. 31(No. 2): 260-272.e7, (Feb. 8, 2023). [doi:10.1016/j.chom.2023.01.002.].
U.S. Appl. No. 17/863,864, Final Office Action mailed Mar. 14, 2025.
U.S. Appl. No. 17/863,864, Notice of Allowance mailed Aug. 18, 2025.
WIPO Application No. PCT/US2016/014720, PCT International Search Report and Written Opinion of the International Searching Authority mailed Jun. 21, 2016.

* cited by examiner

| Position in spike protein | 74 | 79 | 259 | 444 | 445 | 450 | 453 | 484 | 486 | 655 | 682 | 685 | 687 | 769 | 779 | 1128 |
|---|---|---|---|---|---|---|---|---|---|---|---|---|---|---|---|---|
| Original Residue | N | F | T | K | V | N | Y | E | F | H | R | R | V | G | Q | V |
| Mutated Residue | K | I | K | Q | A | D | F | K | V | Y | Q | S | G | E | K | A |
| mAb10989 | | | | | | | | ▨ | | ▨ | | | | | ▨ | |
| mAb10987 | | | | ▨ | ▨ | | | | | ▨ | | ▨ | | | | |
| mAb10933 | | | | | | | ▨ | | ▨ | | ▨ | | ▨ | ▨ | | |
| mAb10934 | | | | | | ▨ | | | | ▨ | ▨ | | | | | |
| mAb10987 + mAb10933 | | | | | | | | | | ▨ | ▨ | | ▨ | | | ▨ |
| mAb10989 + mAb10934 | | | | | | | | ▨ | | ▨ | ▨ | | | | | |
| IgG1 isotype control | ▨ | ▨ | ▨ | | | | | | | ▨ | ▨ | | | | | |
| virus only control | | | ▨ | | | | | | | ▨ | ▨ | | | | | |

FIG. 1

| Strain | Cleavage Site Sequence | Cleavage Site Type |
| --- | --- | --- |
| SARS-CoV-2 S WT | $Q_{677}$ TNSP<u>RRAR</u> ǀ $SV_{687}$ | Polybasic |
| SARS-CoV-2 S FurMut | $Q_{677}$ TILR ǀ $SV_{687}$ | Monobasic |
| SARS-CoV-2 S FurKO | $Q_{677}$ $TNSPGSASSV_{687}$ | KO |

FIG.12A

Pre-mix Competition between anti-SARS-CoV-2 mAbs

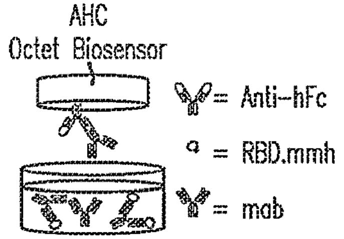

Bi-directional Competition

Partial competition

No competition

Self-self competition

| Phase I | Measure mAb1 captured | Phase II measure IgG blocking mAb (nm) | Phase III, Response of 100 nM SARS CoV-2 RBD-MMH complexed 600 nM of mAb2 binding site (nm) Pre-mix Competition | | | | | | | | |
|---|---|---|---|---|---|---|---|---|---|---|---|
| mAb | nm captured mAb | nm mAb bound | mAb10977 | mAb10989 | mAb10933 | mAb10964 | mAb10984 | mAb10986 | mAb10954 | mAb10934 | mAb10987 |
| mAb10977 | 1.69 ± 0.05 | 0.27 + .08 | 0.00 | -0.03 | -0.01 | -0.04 | -0.02 | 0.46 | 0.33 | 0.00 | 0.96 |
| mAb10989 | 1.95 ± 0.03 | | 0.07 | 0.00 | -0.04 | -0.03 | -0.04 | 0.03 | -0.01 | -0.07 | 0.30 |
| mAb10933 | 1.73 ± 0.06 | | 0.10 | 0.04 | 0.00 | -0.01 | -0.01 | 0.04 | 0.00 | 0.25 | 1.52 |
| mAb10964 | 1.90 ± 0.03 | | 0.04 | 0.02 | 0.04 | 0.00 | -0.01 | 0.05 | 0.04 | 0.38 | 1.37 |
| mAb10984 | 1.88 ± 0.04 | | 0.11 | 0.03 | 0.15 | 0.02 | 0.00 | 0.08 | 0.06 | 0.55 | 1.13 |
| mAb10986 | 1.73 ± 0.04 | | 1.09 | 0.14 | 0.32 | -0.03 | -0.06 | 0.00 | -0.04 | 0.86 | 1.21 |
| mAb10954 | 1.83 ± 0.04 | | 0.85 | 0.03 | 0.53 | -0.01 | -0.04 | 0.02 | 0.00 | 1.12 | 1.16 |
| mAb10934 | 1.78 ± 0.06 | | 0.07 | 0.05 | 0.03 | -0.03 | 0.65 | 1.23 | 1.60 | 0.00 | 0.31 |
| mAb10987 | 1.83 ± 0.04 | | 1.29 | 0.06 | 0.76 | 0.85 | 1.03 | 1.05 | 1.07 | -0.08 | 0.00 |

FIG. 14

| Increasing HDX Protection | |
|---|---|
| | $\Delta D\% < -25\%$ |
| | $-25\% < \Delta D\% < -20\%$ |
| | $-20\% < \Delta D\% < -15\%$ |
| | $-15\% < \Delta D\% < -10\%$ |
| | $-10\% < \Delta D\% < -5\%$ |
| | $-5\% < \Delta D\% < 5\%$ |
| | = No data |

| HDX Epitope Custer (EC) | RBD with ACE2 Contacting Residues | Front View | Top View Front Back | Back View |
|---|---|---|---|---|
| EC 1 | mAb10987 | | | |
| | mAb10934 | | | |
| EC 2 | mAb10989 | | | |
| | mAb10977 | | | |
| | mAb10933 | | | |
| EC 3 | mAb10954 | | | |
| | mAb10986 | | | |
| | mAb10964 | | | |
| EC 4 | mAb10984 | | | |

| | SARS-CoV-2 RBD : mAb10933 : mAb10987 complex |
|---|---|
| **Data collection and processing** | |
| Magnification | 105,000 |
| Voltage (kV) | 300 |
| Electron exposure ($e^-/Å^2$) | 40 |
| Defocus range (μm) | 1.6–3.0 |
| Pixel size (Å) | 0.85 |
| Symmetry imposed | C1 |
| Initial number of particles | 989,553 |
| Final selected particles | 61,707 |
| Map resolution (Å) | 3.9 |
| FSC threshold | 0.143 |
| **Refinement** | |
| Map sharpening B factor ($Å^2$) | −122 |
| Model composition (# of atoms) | 7979 |
| Model vs. map correlation coefficient | 0.64 |
| **R.m.s. deviations** | |
| Bond lengths (Å) | 0.02 |
| Bond angles (°) | 1.12 |
| **Validation** | |
| MolProbity score | 2.7 |
| Rotameric outliers (%) | 1.0 |
| **Ramachandran plot** | |
| Favored (%) | 83.0 |
| Allowed (%) | 16.3 |
| Disallowed (%) | 0.7 |

FIG.17

| Passage | Antibody concentration μg/ml | | | | | |
|---|---|---|---|---|---|---|
| P1 | 50 | 10 | 2 | 0.4 | 0.08 | 0.016 | No Ab |
| mAb10933 | 15% | 30% | 30% | 30% | 30% | ≥ 90% | ≥ 90% |
| mAb10934 | 0% | 15% | 50% | ≥ 90% | ≥ 90% | ≥ 90% | ≥ 90% |
| mAb10987 | 0% | 0% | 5% | 20% | ≥ 90% | ≥ 90% | ≥ 90% |
| mAb10989 | 2–5% | 2–5% | 30% | 50% | ≥ 90% | ≥ 90% | ≥ 90% |
| mAb10987 + mAb10933 | 0% | 0% | 0% | 0% | 20% | ≥ 90% | ≥ 90% |
| mAb10989 + mAb10934 | 2–5% | 2–5% | 20% | 20% | 50% | ≥ 90% | ≥ 90% |
| mAb10989 + mAb10987 | 0% | 0% | 0% | 0% | 60% | ≥ 90% | ≥ 90% |
| IgG Isotype Control | ≥ 90% | ≥ 90% | ≥ 90% | ≥ 90% | ≥ 90% | ≥ 90% | ≥ 90% |
| P2 | 50 | 10 | 2 | 0.4 | 0.08 | 0.016 | No Ab |
| mAb10933 | ≥ 90% | ≥ 90% | ≥ 90% | ≥ 90% | ≥ 90% | ≥ 90% | ≥ 90% |
| mAb10934 | 0% | 40% | ≥ 90% | ≥ 90% | ≥ 90% | ≥ 90% | ≥ 90% |
| mAb10987 | 70% | 80% | ≥ 90% | ≥ 90% | ≥ 90% | ≥ 90% | ≥ 90% |
| mAb10989 | 80% | ≥ 90% | ≥ 90% | ≥ 90% | ≥ 90% | ≥ 90% | ≥ 90% |
| mAb10987 + mAb10933 | 0% | 0% | 0% | 0% | 0% | 0% | ≥ 90% |
| mAb10989 + mAb10934 | ≥ 90% | ≥ 90% | ≥ 90% | ≥ 90% | ≥ 90% | ≥ 90% | ≥ 90% |
| mAb10989 + mAb10987 | 0% | 0% | 0% | 0% | 0% | ≥ 90% | ≥ 90% |
| IgG Isotype Control | ≥ 90% | ≥ 90% | ≥ 90% | ≥ 90% | ≥ 90% | ≥ 90% | ≥ 90% |

FIG. 18C

| | Position in genome | 3299 | 3312 | 3853 | 4326 | 4407 | 4408 | 4411 | 4425 | 4435 | 4442 | 4527 | 4531 | 4533 | 4545 | 4546 | 4554 | 5040 | 5122 | 5130 | 5137 | 5383 | 5412 | 6460 |
|---|---|---|---|---|---|---|---|---|---|---|---|---|---|---|---|---|---|---|---|---|---|---|---|---|
| | Position in spike gene | 222 | 235 | 776 | 1249 | 1330 | 1331 | 1334 | 1348 | 1358 | 1365 | 1450 | 1454 | 1456 | 1468 | 1469 | 1477 | 1963 | 2045 | 2053 | 2060 | 2306 | 2335 | 3383 |
| | Reference nucleotide | T | T | C | A | A | A | T | A | A | G | G | G | T | T | T | C | C | G | C | T | G | C | T |
| | Variant nucleotide | A | A | A | G | C | C | C | G | T | T | A | A | G | C | C | A | T | A | A | G | A | A | C |
| | Position in protein | 74 | 79 | 259 | 417 | 444 | 444 | 445 | 450 | 453 | 455 | 484 | 485 | 486 | 490 | 490 | 493 | 655 | 682 | 685 | 687 | 769 | 779 | 1128 |
| | Ref Residue | N | F | T | K | K | K | V | N | Y | L | E | G | F | F | F | Q | H | R | R | V | G | Q | V |
| | Variant Residue | K | I | K | E | Q | Q | A | D | F | F | K | D | V | P | P | K | Y | Q | S | G | E | K | A |
| PASSAGE1 | Inoculum | 0% | 0% | 0% | 0% | 0% | 0% | 0% | 0% | 0% | 0% | 0% | 0% | 0% | 0% | 0% | 0% | 37% | 16% | 0% | 1% | 0% | 0% | 0% |
| | 10933 0.4μg/ml | 0% | 0% | 0% | 12% | 0% | 0% | 0% | 0% | 29% | 16% | 0% | 0% | 11% | 0% | 0% | 3% | 51% | 18% | 0% | 31% | 11% | 0% | 0% |
| | 10934 2μg/ml | 0% | 0% | 0% | 0% | 3% | 0% | 0% | 34% | 0% | 0% | 14% | 0% | 0% | 0% | 43% | 0% | 63% | 43% | 3% | 0% | 0% | 0% | 0% |
| | 10987 2μg/ml | 0% | 0% | 0% | 0% | 30% | 0% | 36% | 0% | 0% | 0% | 0% | 0% | 0% | 0% | 0% | 0% | 54% | 22% | 29% | 1% | 0% | 0% | 0% |
| | 10989 10μg/ml | 0% | 0% | 0% | 0% | 0% | 0% | 0% | 0% | 0% | 0% | 99% | 0% | 0% | 0% | 0% | 0% | 99% | 2% | 0% | 0% | 0% | 15% | 0% |
| | 10989 0.08μg/ml | 0% | 0% | 0% | 0% | 0% | 0% | 0% | 0% | 0% | 0% | 25% | 8% | 0% | 19% | 14% | 11% | 67% | 28% | 0% | 9% | 0% | 0% | 0% |
| | 10987/33 0.08μg/ml | 0% | 0% | 0% | 0% | 0% | 0% | 0% | 0% | 0% | 0% | 0% | 0% | 0% | 0% | 0% | 0% | 49% | 26% | 1% | 3% | 1% | 0% | 0% |
| | 10989/34 0.08μg/ml | 0% | 0% | 0% | 0% | 0% | 0% | 0% | 0% | 0% | 0% | 51% | 0% | 0% | 0% | 22% | 0% | 76% | 23% | 0% | 2% | 0% | 0% | 0% |
| | 10989/87 0.08μg/ml | 0% | 0% | 0% | 0% | 0% | 0% | 0% | 0% | 0% | 0% | 2% | 0% | 0% | 0% | 0% | 0% | 32% | 27% | 1% | 3% | 1% | 0% | 0% |
| | Isotype Control 50μg/ml | 0% | 0% | 0% | 0% | 0% | 0% | 0% | 0% | 0% | 0% | 0% | 0% | 0% | 0% | 0% | 0% | 61% | 28% | 0% | 4% | 0% | 0% | 0% |
| | Virus Only | 0% | 0% | 0% | 0% | 0% | 0% | 0% | 0% | 0% | 0% | 0% | 0% | 0% | 0% | 0% | 0% | 64% | 27% | 0% | 4% | 0% | 0% | 0% |
| PASSAGE2 | 10933 50μg/ml | 0% | 0% | 0% | 0% | 0% | 0% | 0% | 0% | 10% | 0% | 0% | 0% | 88% | 0% | 0% | 0% | 1% | 90% | 0% | 15% | 87% | 0% | 0% |
| | 10934 50μg/ml | 0% | 0% | 0% | 0% | 0% | 0% | 0% | 95% | 0% | 0% | 6% | 0% | 0% | 0% | 1% | 0% | 10% | 93% | 0% | 0% | 0% | 0% | 0% |
| | 10987 50μg/ml | 0% | 0% | 0% | 0% | 45% | 0% | 41% | 0% | 0% | 0% | 0% | 0% | 0% | 0% | 0% | 0% | 50% | 6% | 47% | 0% | 0% | 0% | 0% |
| | 10989 50μg/ml | 0% | 0% | 0% | 0% | 0% | 0% | 0% | 0% | 0% | 0% | 100% | 0% | 0% | 0% | 0% | 0% | 100% | 0% | 0% | 0% | 0% | 20% | 0% |
| | 10987/33 0.016μg/ml | 0% | 0% | 0% | 0% | 0% | 8% | 0% | 0% | 0% | 0% | 0% | 0% | 0% | 0% | 0% | 0% | 22% | 63% | 0% | 22% | 0% | 0% | 36% |
| | 10989/34 50μg/ml | 0% | 0% | 0% | 0% | 0% | 0% | 0% | 0% | 0% | 0% | 100% | 0% | 0% | 0% | 0% | 0% | 93% | 11% | 0% | 0% | 0% | 0% | 0% |
| | 10989/87 50μg/ml | ND | ND | ND | ND | ND | ND | ND | ND | ND | ND | ND | ND | ND | ND | ND | ND | ND | ND | ND | ND | ND | ND | ND |
| | Isotype Control 50μg/ml | 16% | 13% | 10% | 0% | 0% | 0% | 0% | 0% | 0% | 0% | 0% | 0% | 0% | 0% | 0% | 0% | 54% | 50% | 0% | 8% | 0% | 0% | 4% |
| | Virus Only | 8% | 8% | 22% | 0% | 0% | 0% | 0% | 0% | 0% | 0% | 0% | 0% | 0% | 0% | 0% | 0% | 28% | 83% | 0% | 7% | 0% | 0% | 8% |

| Frequency < 10% | Frequency 10% < x < 50% | Frequency > 50% |
|---|---|---|

FIG. 19

| Escape mutants | anti-SARS-COV-2 spike monoclonal antibodies | | | | | | |
|---|---|---|---|---|---|---|---|
| | mAb10989 | mAb10987 | mAb10933 | mAb10934 | mAb10933/ mAb10987 | mAb10989/ mAb10934 | mAb10989/ mAb10987 |
| Wild-type | 7.27E-12 | 3.65E-11 | 5.57E-11 | 5.99E-11 | 3.28E-11 | 8.27E-12 | 1.22E-11 |
| K417E | 2.49E-11 | 3.10E-11 | 8.33E-9 | 2.70E-11 | 4.15E-11 | 2.64E-11 | 2.72E-11 |
| K444Q | 2.47E-11 | NC | 7.81E-11 | 5.38E-9 | 1.23E-10 | 4.19E-11 | 4.82E-11 |
| V445A | 2.65E-11 | NC | 8.82E-11 | 1.42E-10 | 1.54E-10 | 4.08E-11 | 5.74E-11 |
| N450D | 4.10E-11 | 1.20E-9 | 7.60E-11 | NC | 1.88E-10 | 6.04E-11 | 5.37E-11 |
| Y453F | 2.77E-11 | 1.04E-10 | NC | 2.17E-10 | 1.15E-10 | 3.52E-11 | 2.41E-11 |
| L455F | 1.77E-11 | 3.87E-11 | NC | 4.34E-11 | 5.87E-11 | 1.96E-11 | 1.70E-11 |
| E484K | NC | 6.25E-11 | 1.13E-9 | NC | 6.19E-11 | NC | 1.88E-10 |
| G485D | NC | 2.34E-11 | 2.05E-10 | 4.47E-11 | 4.71E-11 | 1.19E-10 | 4.58E-11 |
| F486V | NC | 3.16E-11 | NC | 3.50E-11 | 8.8E-11 | 1.29E-10 | 6.96E-11 |
| F490P | 6.76E-10 | 3.75E-11 | 8.65E-11 | NC | 5.41E-11 | 2.55E-9 | 6.82E-11 |
| Q493K | NC | 4.19E-11 | NC | 3.46E-11 | 3.24E-11 | 4.55E-10 | 5.94E-11 |

FIG. 20

Fold decrease in IC50 from reference (D614G) pseudovirus

| Variant | REGN10933 | REGN10987 | REGN10933+ REGN10987 |
|---|---|---|---|
| UK B.1.1.7 | 1.2 | 0.7 | 0.9 |
| L452R (California B.1.429) | 1.29 | 1.07 | 1.23 |
| E484K | 15.0 | 1.2 | 1.6 |
| South Africa B.1.351 | 44.66 | 0.18 | 0.60 |
| E484K/K417T (Brazil P.1) | 142.85 | 0.66 | 1.43 |

FIG.23B

| Antibody | Mutations associated with escape (>15% frequency) | Passage in which escape mutants were identified |
|---|---|---|
| REGN10933 | F486V (87.7%) | 2 |
| REGN10985 | R408I (39.7%)<br>G504D(40.4%) | 1 |
| REGN10987 | K444Q(44.2%)<br>V445A(39.9%) | 2 |
| REGN10933+REGN10987 | K417R(99.6%)<br>K444Q(99.7%)<br>G476S(90.0%) | 7 |
| REGN10933+REGN10987+REGN10985 | None | Passaged up to P11 |
| CB6 | K417N(99.7%) | 1 |
| COV555 | E484K(38.1%)<br>Q493R(55.6%) | 1 |
| COV2-2130 | K444Q(85.1%) | 1 |
| COV2-2196 | G476D(81.4%)<br>N487D(18.2%) | 2 |
| COV2-2130+COV2-2196* | None | Passaged up to P3 |
| VIR-7831 | P337L (15.56%)<br>E340D (19.02%)<br>T345P (69.3%) | 2 |

FIG. 24B

| | |
|---|---|
| Challenge route | intranasal |
| Challenge dose | 1x10^4 PFU WA isolate |
| mAb/s | REGN10933<br>REGN10987<br>REGN10933+REGN10987 |
| doses | 50,5 (mg/kg) |

Variants identified in 2 samples from at least 1 patient.

Placebo patients:
Spike variants = 18
RBD variants = 1

D427N

REGEN–COV low dose patients:
Spike variants = 12
RBD variants = 3

N501T
S477N
K537R

REGEN–COV high dose patients:
Spike variants = 15
RBD variants = 2

S477N
N501T

Amino acid position

NTD    RBD    S2

Statistics on sequenced data for each clinical group from study 2066 and 2067.

| | Study 2066 | | | Study 2067 | | |
|---|---|---|---|---|---|---|
| | Number of patients | Number of samples different time points | Number of variants (variants pers sample) | Number of patients | Number of samples different time points | Number of variants (variants pers sample) |
| Total | 272 | 1,336 | 244 (0.18) | 728 | 3,546 | 514 (0.14) |
| Placebo | 91 | 472 | 90 (0.19) | 243 | 1,215 | 216 (0.18) |
| Treated all | 181 | 864 | 184 (0.21) | 485 | 2,331 | 399 (0.17) |
| Treated low dose* | 88 | 423 | 88 (0.21) | 247 | 1,203 | 248 (0.21) |
| Treated high dose* | 93 | 441 | 109 (0.25) | 238 | 1,128 | 212 (0.19) |

**low dose = 2.4g IV*
*high dose = 8.0g IV*

FIG. 30

Fold decrease in IC50 from reference (D614G) pseudovirus

| Variant | REGN10933 | REGN10987 | REGN10933+ REGN10987 |
|---|---|---|---|
| G446V | 0.4 | 135.00 | 0.48 |
| S477N | 2.85 | 2.28 | 1.92 |
| S494P | 4.48 | 0.98 | 1.06 |
| N501Y* | 0.9 | 0.5 | 1.1 |
| K537R | 1.06 | 0.82 | 0.98 |

FIG.33B

| | | REGN10933 | REGN10987 | REGN-COV2 |
|---|---|---|---|---|
| Variant | Treatment mAb | Decrease in IC50 over reference pseudovirus | | |
| P384L | 10987 | 1.91 | 1.29 | 1.65 |
| K444T | 10987 | 1.98 | 1032.52 | 6.42 |
| V445A | 10987 | 1.93 | 548.10 | 4.69 |
| G446S | 10987 | N/A | N/A | N/A |
| G446D | 10987 | N/A | N/A | N/A |
| G446V* | N/A | 0.40 | 134.97 | 0.48 |
| L455W | 10933 | N/A | N/A | N/A |
| L455F* | N/A | 79.54 | 1.06 | 1.79 |
| F486S | 10933 | N/A | N/A | N/A |
| F486L* | N/A | 61.44 | 0.87 | 1.49 |
| F486V* | N/A | 437.54 | 0.87 | 2.68 |

FIG. 34

ANTI-SARS-CoV-2-SPIKE GLYCOPROTEIN ANTIBODIES AND ANTIGEN-BINDING FRAGMENTS

CROSS-REFERENCE TO RELATED APPLICATIONS

This application is a US National Stage Application under 35 USC § 371 of PCT/US2021/034187, filed May 26, 2021, which claims the benefit under 35 USC § 119(e) of US Provisional Application Nos.: 63/030,260, filed May 26, 2020; 63/033,198, filed Jun. 1, 2020; 63/093,888, filed Oct. 20, 2020; 63/112,143, filed Nov. 10, 2020; 63/141,956, filed Jan. 26, 2021; 63/142,472, filed Jan. 27, 2021; 63/145,389, filed Feb. 3, 2021; and 63/159,437, filed Mar. 10, 2021, each of which is incorporated herein by reference in its entirety for all purposes.

FEDERALLY SPONSORED RESEARCH OR DEVELOPMENT

This invention was made with Government support under Agreement HHSO100201700020C, awarded by the U.S. Department of Health and Human Services. The Government has certain rights in the invention.

SEQUENCE LISTING

This application incorporates by reference the Sequence Listing submitted in computer readable form as file 10810US01-Substitute-Sequence-Listing, created on Jun. 19, 2023 and containing 933,739 bytes.

FIELD OF THE INVENTION

The present invention relates to antibodies and antigen-binding fragments that bind specifically to coronavirus spike proteins and methods for treating or preventing coronavirus infections with said antibodies and fragments.

BACKGROUND OF THE INVENTION

Newly identified viruses, such as coronaviruses, can be difficult to treat because they are not sufficiently characterized. The emergence of these newly identified viruses highlights the need for the development of novel antiviral strategies. Severe acute respiratory syndrome coronavirus 2 (SARS-CoV-2) is a newly-emergent coronavirus which causes a severe acute respiratory disease, COVID-19. SARS-CoV-2 was first identified from an outbreak in Wuhan, China and as of Mar. 20, 2020, the World Health Organization has reported 209,839 confirmed cases in 168 countries, areas, or territories, resulting in 8,778 deaths. Clinical features of COVID-19 include fever, dry cough, and fatigue, and the disease can cause respiratory failure resulting in death.

Thus far, there has been no vaccine or therapeutic agent to prevent or treat SARS-CoV-2 infection. In view of the continuing threat to human health, there is an urgent need for preventive and therapeutic antiviral therapies for SARS-CoV-2 control. Because this virus uses its spike glycoprotein for interaction with the cellular receptor ACE2 and the serine protease TMPRSS2 for entry into a target cell, this spike protein represents an attractive target for antibody therapeutics. In particular, fully human antibodies that specifically bind to the SARS-CoV-2-Spike protein (SARS- CoV-2-S) with high affinity and that inhibit virus infectivity could be important in the prevention and treatment of COVID-19.

SUMMARY OF THE INVENTION

There is a need for neutralizing therapeutic anti-SARS-CoV-2-Spike protein (SARS-CoV-2-S) antibodies and their use for treating or preventing viral infection. The present disclosure addresses this need, in part, by providing human anti-SARS-CoV-2-S antibodies, such as those of Table 1, and combinations thereof including, for example, combinations with other therapeutics (e.g., anti-inflammatory agents, antimalarial agents, antiviral agents, or other antibodies or antigen-binding fragments), and methods of use thereof for treating viral infections.

The present disclosure provides neutralizing human antigen-binding proteins that specifically bind to SARS-CoV-2-S, for example, antibodies or antigen-binding fragments thereof.

In one aspect, the present disclosure provides a method for selecting a plurality of antibodies or antigen-binding fragments thereof for use in treating a viral infection, comprising: a) determining a first frequency of escape mutants resulting from a first antibody or antigen-binding fragment thereof alone; b) determining a second frequency of escape mutants resulting from a second antibody or antigen-binding fragment thereof alone; c) determining a third frequency of escape mutants resulting from a combination of the first antibody or antigen-binding fragment thereof and the second antibody or antigen-binding fragment thereof; and d) selecting the combination for use in treating the viral infection if the third frequency is lower than the first frequency and the second frequency; wherein the first antibody or antigen-binding fragment thereof binds to a first epitope of a viral surface protein and the second antibody or antigen-binding fragment thereof binds to a second epitope of a viral surface protein, and further wherein the first epitope and the second epitope are non-overlapping.

In some cases, the viral infection is a coronavirus infection. In some embodiments, the coronavirus is SARS-CoV-2. In some cases, the escape mutant is a mutant in a SARS-CoV-2 surface protein. In some embodiments, the surface protein is spike protein.

In some embodiments of the method, the frequency of SARS-CoV-2 spike protein escape mutants is measured by: a) contacting a population of cells with the first antibody or antigen-binding fragment thereof, and with a virus expressing the SARS-CoV-2 spike protein, sequencing nucleic acids from the population of cells, and determining a first frequency of SARS-CoV-2 spike protein mutations; b) contacting a comparable population of cells with the second antibody or antigen-binding fragment thereof, and with a virus expressing the SARS-CoV-2 spike protein, sequencing nucleic acids from the population of cells, and determining a second frequency of SARS-CoV-2 spike protein mutations; c) contacting a comparable population of cells with the first antibody or antigen-binding fragment thereof and the second antibody or antigen-binding fragment thereof, and with a virus expressing the SARS-CoV-2 spike protein, sequencing nucleic acids from the population of cells, and determining a third frequency of SARS-CoV-2 spike protein mutations; and d) comparing the first frequency, the second frequency, and the third frequency.

In some cases, the first epitope and the second epitope are selected from the group consisting of: a) amino acids 432-452 of SEQ ID NO: 832; b) amino acids 471-486 of SEQ ID NO: 832; and c) amino acids 491-515 of SEQ ID NO: 832.

In various embodiments, the first antibody or antigen-binding fragment thereof and the second antibody or antigen-binding fragment thereof are selected from the antibodies or antigen-binding fragments of Table 1. In some cases, the first antibody and the second antibody are selected from among two of the following groups: a) mAb10987, mAb10922, mAb10936, and mAb10934; b) mAb10989, mAb10977, and mAb10933; c) mAb10920; d) mAb10954, mAb10986, and mAb10964; and e) mAb10984. In some embodiments, the first antibody and the second antibody are selected from the group consisting of: mAb10987, mAb10934, mAb10989, and mAb10933.

In one aspect, the present disclosure provides a method of treating a viral infection in a subject, comprising administering a first antibody or antigen-binding fragment thereof and a second antibody or antigen-binding fragment thereof to the subject, wherein: a) the first antibody or antigen-binding fragment thereof binds to a first epitope of a SARS-CoV-2 spike protein and the second antibody or antigen-binding fragment thereof binds to a second epitope of the SARS-CoV-2 spike protein; b) the first epitope and the second epitope are different; and c) administration of the first antibody or antigen-binding fragment thereof and the second antibody or antigen-binding fragment thereof results in a reduced frequency of SARS-CoV-2 spike protein escape mutants as compared to administration of the first antibody or antigen-binding fragment thereof alone or the second antibody or antigen-binding fragment thereof alone.

In some embodiments of the method, the frequency of SARS-CoV-2 spike protein escape mutants is measured by: a) contacting a population of cells with the first antibody or antigen-binding fragment thereof and the second antibody or antigen-binding fragment thereof, and with a virus expressing the SARS-CoV-2 spike protein, sequencing nucleic acids from the population of cells, and determining a first frequency of SARS-CoV-2 spike protein mutations; b) contacting a comparable population of cells with the first antibody or antigen-binding fragment thereof alone or the second antibody or antigen-binding fragment thereof alone, and with a virus expressing the SARS-CoV-2 spike protein, sequencing nucleic acids from the population of cells, and determining a second frequency of SARS-CoV-2 spike protein mutations; and c) comparing the first frequency and the second frequency.

In some cases, the first epitope and the second epitope are non-overlapping. In some embodiments, the first epitope and the second epitope are selected from the group consisting of: a) amino acids 432-452 of SEQ ID NO: 832; b) amino acids 471-486 of SEQ ID NO: 832; and c) amino acids 491-515 of SEQ ID NO: 832.

In various embodiments, the first antibody or antigen-binding fragment thereof and the second antibody or antigen-binding fragment thereof are selected from the antibodies or antigen-binding fragments of Table 1. In some cases, the first antibody and the second antibody are selected from among two of the following groups: a) mAb10987, mAb10922, mAb10936, and mAb10934; b) mAb10989, mAb10977, and mAb10933; c) mAb10920; d) mAb10954, mAb10986, and mAb10964; and e) mAb10984. In some embodiments, the first antibody and the second antibody are selected from the group consisting of: mAb10987, mAb10934, mAb10989, and mAb10933.

In various embodiments, the first antibody or antigen-binding fragment thereof and the second antibody or antigen-binding fragment thereof are administered concurrently. In various embodiments, the first antibody or antigen-binding fragment thereof and the second antibody or antigen-binding fragment thereof are administered sequentially.

In some cases, the subject is infected with SARS-CoV-2. In some embodiments, the subject has COVID-19.

In one aspect, the present disclosure provides a method of treating a viral infection in a subject, comprising administering a first antibody or antigen-binding fragment thereof and a second antibody or antigen-binding fragment thereof to the subject, wherein: a) the first antibody or antigen-binding fragment thereof binds to a first epitope of a SARS-CoV-2 spike protein and the second antibody or antigen-binding fragment thereof binds to a second epitope of the SARS-CoV-2 spike protein; b) the first epitope and the second epitope are non-overlapping; and c) administration of the first antibody or antigen-binding fragment thereof and the second antibody or antigen-binding fragment thereof results in a reduced frequency of SARS-CoV-2 spike protein escape mutants as compared to administration of a combination of antibodies that bind to overlapping epitopes of the SARS-CoV-2 spike protein.

In some embodiments of the method, the frequency of SARS-CoV-2 spike protein escape mutants is measured by: a) contacting a population of cells with the first antibody or antigen-binding fragment thereof and the second antibody or antigen-binding fragment thereof, and with a virus expressing the SARS-CoV-2 spike protein, sequencing nucleic acids from the population of cells, and determining a first frequency of SARS-CoV-2 spike protein mutations; b) contacting a comparable population of cells with the combination of antibodies that binds to overlapping epitopes of the SARS-CoV-2 spike protein, and with a virus expressing the SARS-CoV-2 spike protein, sequencing nucleic acids from the population of cells, and determining a second frequency of SARS-CoV-2 spike protein mutations; and c) comparing the first frequency and the second frequency.

In some cases, the first epitope and the second epitope are selected from the group consisting of: a) amino acids 432-452 of SEQ ID NO: 832; b) amino acids 471-486 of SEQ ID NO: 832; and c) amino acids 491-515 of SEQ ID NO: 832.

In various embodiments, the first antibody or antigen-binding fragment thereof and the second antibody or antigen-binding fragment thereof are selected from the antibodies or antigen-binding fragments of Table 1. In some cases, the first antibody and the second antibody are selected from among two of the following groups: a) mAb10987, mAb10922, mAb10936, and mAb10934; b) mAb10989, mAb10977, and mAb10933; c) mAb10920; d) mAb10954, mAb10986, and mAb10964; and e) mAb10984. In some cases, the first antibody and the second antibody are selected from the group consisting of: mAb10987, mAb10934, mAb10989, and mAb10933. In some cases, the first antibody or antigen-binding fragment thereof and the second antibody or antigen-binding fragment thereof are administered concurrently. In some cases, the first antibody or antigen-binding fragment thereof and the second antibody or antigen-binding fragment thereof are administered sequentially.

In some embodiments, the subject is infected with SARS-CoV-2. In some embodiments, the subject has COVID-19.

In one aspect, the present disclosure provides a method for controlling the proliferation of viral escape mutants, the method comprising administering to a subject a first antibody or antigen-binding fragment thereof and a second antibody or antigen-binding fragment thereof, wherein the first antibody or antigen binding fragment thereof and the second antibody or antigen-binding fragment thereof both bind to a viral surface protein, wherein the first antibody or antigen binding fragment thereof and the second antibody or antigen-binding fragment thereof do not compete with one another for binding to the viral surface protein, and further wherein the subject is infected with a virus expressing the viral surface protein.

In some embodiments, the virus is a coronavirus. In some cases, the coronavirus is SARS-CoV-2 and the viral surface protein is spike protein.

In various embodiments, the first antibody or antigen-binding fragment thereof and the second antibody or antigen-binding fragment thereof are selected from the antibodies or antigen-binding fragments of Table 1. In some cases, the first antibody and the second antibody are selected from among two of the following groups: a) mAb10987, mAb10922, mAb10936, and mAb10934; b) mAb10989, mAb10977, and mAb10933; c) mAb10920; d) mAb10954, mAb10986, and mAb10964; and e) mAb10984. In some cases, the first antibody and the second antibody are selected from the group consisting of: mAb10987, mAb10934, mAb10989, and mAb10933.

In one aspect, the present disclosure provides a pharmaceutical composition comprising a first antibody or antigen-binding fragment thereof and a second antibody or antigen-binding fragment thereof, wherein: a) the first antibody or antigen-binding fragment thereof binds to a first epitope of a SARS-CoV-2 spike protein and the second antibody or antigen-binding fragment thereof binds to a second epitope of the SARS-CoV-2 spike protein; b) the first epitope and the second epitope are different; and c) the first antibody or antigen-binding fragment thereof and the second antibody or antigen-binding fragment thereof result in a reduced frequency of SARS-CoV-2 spike protein escape mutants as compared to the first antibody or antigen-binding fragment thereof alone or the second antibody or antigen-binding fragment thereof alone.

In some embodiments, the frequency of SARS-CoV-2 spike protein escape mutants is measured by: a) contacting a population of cells with the first antibody or antigen-binding fragment thereof and the second antibody or antigen-binding fragment thereof, and with a virus expressing the SARS-CoV-2 spike protein, sequencing nucleic acids from the population of cells, and determining a first frequency of SARS-CoV-2 spike protein mutations; b) contacting a comparable population of cells with the first antibody or antigen-binding fragment thereof alone or the second antibody or antigen-binding fragment thereof alone, and with a virus expressing the SARS-CoV-2 spike protein, sequencing nucleic acids from the population of cells, and determining a second frequency of SARS-CoV-2 spike protein mutations; and c) comparing the first frequency and the second frequency.

In some cases, the first epitope and the second epitope are non-overlapping. In some embodiments, the first epitope and the second epitope are selected from the group consisting of: a) amino acids 432-452 of SEQ ID NO: 832; b) amino acids 471-486 of SEQ ID NO: 832; and c) amino acids 491-515 of SEQ ID NO: 832.

In various embodiments, the first antibody or antigen-binding fragment thereof and the second antibody or antigen-binding fragment thereof are selected from the antibodies or antigen-binding fragments of Table 1. In some cases, the first antibody and the second antibody are selected from among two of the following groups: a) mAb10987, mAb10922, mAb10936, and mAb10934; b) mAb10989, mAb10977, and mAb10933; c) mAb10920; d) mAb10954, mAb10986, and mAb10964; and e) mAb10984. In some embodiments, the first antibody and the second antibody are selected from the group consisting of: mAb10987, mAb10934, mAb10989, and mAb10933.

In some cases, the first antibody or antigen-binding fragment thereof and the second antibody or antigen-binding fragment thereof are administered concurrently to a subject. In some cases, the first antibody or antigen-binding fragment thereof and the second antibody or antigen-binding fragment thereof are administered sequentially to a subject. In some embodiments, the pharmaceutical composition further comprises a pharmaceutically acceptable carrier.

In one aspect, the present disclosure provides a composition comprising: a) a first antibody, or antigen-binding fragment thereof, that binds a SARS-CoV-2 spike protein comprising the amino acid sequence set forth in SEQ ID NO: 832, wherein the isolated antibody or antigen-binding fragment comprises three heavy chain complementarity determining regions (CDRs) (A-HCDR1, A-HCDR2 and A-HCDR3) contained within a heavy chain variable region (A-HCVR) comprising the amino acid sequence set forth in SEQ ID NO: 202, and three light chain CDRs (A-LCDR1, A-LCDR2 and A-LCDR3) contained within a light chain variable region (A-LCVR) comprising the amino acid sequence set forth in SEQ ID NO: 210; b) a second antibody, or antigen-binding fragment thereof, that binds a SARS-CoV-2 spike protein comprising the amino acid sequence set forth in SEQ ID NO: 832, wherein the isolated antibody or antigen-binding fragment thereof comprises three heavy chain CDRs (B-HCDR1, B-HCDR2 and B-HCDR3) contained within a heavy chain variable region (B-HCVR) comprising the amino acid sequence set forth in SEQ ID NO: 640, and three light chain CDRs (B-LCDR1, B-LCDR2 and B-LCDR3) contained within a light chain variable region (B-LCVR) comprising the amino acid sequence set forth in SEQ ID NO: 646; and c) a third antibody, or antigen-binding fragment thereof, that binds a SARS-CoV-2 spike protein comprising the amino acid sequence set forth in SEQ ID NO: 832, wherein the isolated antibody or antigen-binding fragment thereof comprises three heavy chain CDRs (C-HCDR1, C-HCDR2 and C-HCDR3) contained within a heavy chain variable region (C-HCVR) comprising the amino acid sequence set forth in SEQ ID NO: 608, and three light chain CDRs (C-LCDR1, C-LCDR2 and C-LCDR3) contained within a light chain variable region (C-LCVR) comprising the amino acid sequence set forth in SEQ ID NO: 614.

In some embodiments, A-HCDR1 comprises the amino acid sequence set forth in SEQ ID NO: 204, A-HCDR2 comprises the amino acid sequence set forth in SEQ ID NO: 206, A-HCDR3 comprises the amino acid sequence set forth in SEQ ID NO: 208, A-LCDR1 comprises the amino acid sequence set forth in SEQ ID NO: 212, A-LCDR2 comprises the amino acid sequence set forth in SEQ ID NO: 55, and A-LCDR3 comprises the amino acid sequence set forth in SEQ ID NO: 214.

In some embodiments, A-HCVR comprises the amino acid sequence set forth in SEQ ID NO: 202.

In some embodiments, A-LCVR comprises the amino acid sequence set forth in SEQ ID NO: 210.

In some embodiments, A-HCVR comprises the amino acid sequence set forth in SEQ ID NO: 202 and A-LCVR comprises the amino acid sequence set forth in SEQ ID NO: 210.

In some embodiments, B-HCDR1 comprises the amino acid sequence set forth in SEQ ID NO: 642, B-HCDR2 comprises the amino acid sequence set forth in SEQ ID NO: 499, B-HCDR3 comprises the amino acid sequence set forth in SEQ ID NO: 644, B-LCDR1 comprises the amino acid sequence set forth in SEQ ID NO: 648, B-LCDR2 comprises the amino acid sequence set forth in SEQ ID NO: 650, and B-LCDR3 comprises the amino acid sequence set forth in SEQ ID NO: 652.

In some embodiments, B-HCVR comprises the amino acid sequence set forth in SEQ ID NO: 640.

In some embodiments, B-LCVR comprises the amino acid sequence set forth in SEQ ID NO: 646.

In some embodiments, B-HCVR comprises the amino acid sequence set forth in SEQ ID NO: 640 and B-LCVR comprises the amino acid sequence set forth in SEQ ID NO: 646.

In some embodiments, C-HCDR1 comprises the amino acid sequence set forth in SEQ ID NO: 169, C-HCDR2 comprises the amino acid sequence set forth in SEQ ID NO: 610, C-HCDR3 comprises the amino acid sequence set forth in SEQ ID NO: 612, C-LCDR1 comprises the amino acid sequence set forth in SEQ ID NO: 616, C-LCDR2 comprises the amino acid sequence set forth in SEQ ID NO: 584, and C-LCDR3 comprises the amino acid sequence set forth in SEQ ID NO: 618.

In some embodiments, C-HCVR comprises the amino acid sequence set forth in SEQ ID NO: 608.

In some embodiments, C-LCVR comprises the amino acid sequence set forth in SEQ ID NO: 614.

In some embodiments, C-HCVR comprises the amino acid sequence set forth in SEQ ID NO: 608 and C-LCVR comprises the amino acid sequence set forth in SEQ ID NO: 614.

In one aspect, the present disclosure provides a pharmaceutical composition comprising method a plurality of antibodies or antigen-binding fragments thereof for use in treating a viral infection, wherein the antibodies or antigen-binding fragments thereof are selected by: a) determining a first frequency of escape mutants resulting from a first antibody or antigen-binding fragment thereof alone; b) determining a second frequency of escape mutants resulting from a second antibody or antigen-binding fragment thereof alone; c) determining a third frequency of escape mutants resulting from a combination of the first antibody or antigen-binding fragment thereof and the second antibody or antigen-binding fragment thereof; and d) selecting the combination for use in treating the viral infection if the third frequency is lower than the first frequency and the second frequency; wherein the first antibody or antigen-binding fragment thereof binds to a first epitope of a viral surface protein and the second antibody or antigen-binding fragment thereof binds to a second epitope of a viral surface protein, and further wherein the first epitope and the second epitope are selected from the group consisting of: i) amino acids 432-452 of SEQ ID NO: 832; ii) amino acids 471-486 of SEQ ID NO: 832; and iii) amino acids 491-515 of SEQ ID NO: 832.

In some cases, the viral infection is a coronavirus infection. In some cases, the coronavirus is SARS-CoV-2.

In some embodiments, the escape mutant is a mutant in a SARS-CoV-2 surface protein. In some cases, the surface protein is spike protein.

In some embodiments, the frequency of SARS-CoV-2 spike protein escape mutants is measured by: a) contacting a population of cells with the first antibody or antigen-binding fragment thereof, and with a virus expressing the SARS-CoV-2 spike protein, sequencing nucleic acids from the population of cells, and determining a first frequency of SARS-CoV-2 spike protein mutations; b) contacting a comparable population of cells with the second antibody or antigen-binding fragment thereof, and with a virus expressing the SARS-CoV-2 spike protein, sequencing nucleic acids from the population of cells, and determining a second frequency of SARS-CoV-2 spike protein mutations; c) contacting a comparable population of cells with the first antibody or antigen-binding fragment thereof and the second antibody or antigen-binding fragment thereof, and with a virus expressing the SARS-CoV-2 spike protein, sequencing nucleic acids from the population of cells, and determining a third frequency of SARS-CoV-2 spike protein mutations; and d) comparing the first frequency, the second frequency, and the third frequency.

In some embodiments, the first epitope and the second epitope are selected from the group consisting of: a) amino acids 432-452 of SEQ ID NO: 832; b) amino acids 471-486 of SEQ ID NO: 832; and c) amino acids 491-515 of SEQ ID NO: 832.

In various embodiments, the first antibody or antigen-binding fragment thereof and the second antibody or antigen-binding fragment thereof are selected from the antibodies or antigen-binding fragments of Table 1. In some cases, the first antibody and the second antibody are selected from among two of the following groups: a) mAb10987, mAb10922, mAb10936, and mAb10934; b) mAb10989, mAb10977, and mAb10933; c) mAb10920; d) mAb10954, mAb10986, and mAb10964; and e) mAb10984. In some cases, the first antibody and the second antibody are selected from the group consisting of: mAb10987, mAb10934, mAb10989, and mAb10933.

In various embodiments, any of the features or components of embodiments discussed above or herein may be combined, and such combinations are encompassed within the scope of the present disclosure. Any specific value discussed above or herein may be combined with another related value discussed above or herein to recite a range with the values representing the upper and lower ends of the range, and such ranges are encompassed within the scope of the present disclosure.

BRIEF DESCRIPTION OF THE FIGURES

FIG. 1 shows mutated amino acids in viral RNA following incubation with either individual anti-SARS-CoV-2 spike protein antibodies, or combinations of anti-SARS-CoV-2 spike protein antibodies. Changes in viral RNA are shown from wells with highest antibody concentration and detectable cytopathic effect (CPE) on passage 1 relative to input virus. All mutated amino acid residues present at above 10% frequency in conditions described are shown as hatched boxes. Spike protein residues at positions 444, 445, 450, 453, 484 and 486 are located within the receptor binding domain. Mutated amino acids in isotype control and virus only conditions likely represent tissue culture adaptation of the virus.

FIG. 11A displays the neutralization potency of anti-SARS-CoV-2 Spike mAbs. Serial dilutions of anti-Spike mAbs, IgG1 isotype control, and recombinant dimeric ACE2 (hACE2.hFc) were added with pVSV-SARS-CoV-2-S-mNeon to Vero cells and mNeon expression was measured 24 hours post-infection as a read-out for virus infectivity. Data is graphed as percent neutralization relative to virus only infection control. FIG. 11B displays neutralization potency of anti-Spike mAbs, recombinant dimeric ACE2, and IgG1 isotype control against non-replicating pVSV-SARS-CoV-2-S-mNeon in Calu3 cells. FIG. 11C displays neutralization potency of individual anti-Spike mAbs and combinations of mAbs against replicating VSV-SARS-CoV-2-S virus in Vero cells. Cells were infected with an MOI 1 of the virus and stained for viral protein 24 hours post-infection to measure infectivity. FIG. 11D displays neutralization potency of individual anti-Spike mAbs and combinations of mAbs against SARS-CoV-2-S virus in VeroE6 cells.

FIG. 12A, FIG. 12B, and FIG. 12C display the effect of cleavage site mutations on neutralization and infectivity. FIG. 12A, the WT amino acid sequence of the S1/S2 polybasic cleavage site is underlined. FIG. 12B, four-point neutralization curves (Log M: −7.48, −8.48, −9.48, and −10.48) for the lead antibodies in Vero cells. FIG. 12C, infectivity of the WT and cleavage mutants in Vero and Calu-3 cells at 24 and 48 hours, respectively. Infectivity of the mutants was normalized to the infectivity of the WT virus in each cell type.

FIG. 14 displays epitope bin analysis from a matrix of pre-mix binding assays for different anti-SARS-CoV-2 mAbs. Epitope binning was performed against nine anti-SARS-CoV-2 mAb as described. There were three phases (I, II, and III) for each graph. In phase I anti-SARS-CoV-2 mAb (20 ug/ml) was loaded to the anti-human Fc probe. In phase II human IgG1 blocking mAb solution (100 ug/ml). In phase III a solution of 100 nM SARS CoV-2 RBD-MMH pre-mix complex of each 600 nM anti-SARS-CoV-2 mAb binding site flowed over the mAb capture probe.

FIG. 16A displays a 3.9 Å cryoEM map of mAb10933+RBD+mAb10987 complex.

FIG. 17 displays cryoEM data statistics. Data collection and refinement statistics are reported for the mAb10987+mAb10933+SARS-CoV-2 RBD complex structure shown in FIG. 16A and FIG. 16B.

FIG. 18A, FIG. 18B, and FIG. 18C: FIG. 18A displays a schematic of the VSV-SARS-CoV-2-S virus genome encoding residues 1-1255 of the spike protein in place of the VSV glycoprotein. N, nucleoprotein, P, phosphoprotein, M, matrix, and L, large polymerase. FIG. 18B shows that a total of $1.5\times10^6$ pfu of the parental VSV-SARS-CoV-2-S virus was passed in the presence of antibody dilutions for 4 days on Vero E6 cells. Cells were screened for virus replication by monitoring for virus induced cytopathic effect (CPE). Supernatants and cellular RNA were collected from wells under the highest concentration antibody selection with detectable viral replication (circled wells; ≥20% CPE). For a second round of selection, 100 μL of the P1 supernatant was expanded for 4 days under increasing antibody selection in fresh Vero E6 cells. RNA was collected from the well with the highest antibody concentration with detectable viral replication. The RNA was deep sequenced from both passages to identify the escape mutants. FIG. 18C displays the passaging results of the escape study with the percentage of CPE observed in each dilution. Black boxes indicate dilutions that were passaged and sequenced in P1 or sequenced in P2. A no-antibody control was sequenced from each passage to monitor for tissue culture adaptations.

FIG. 19 displays that deep sequencing of passaged virus identifies escape mutants. VSV-SARS-CoV-2-S virus was mixed with either individual or combinations of anti-spike mAbs. Viral RNA from wells with the highest mAb concentration and detectable cytopathic effect (CPE) on passage 1 or 2 (collected 4 days post-infection) was isolated and RNAseq analysis was performed to identify changes in spike protein sequence relative to input virus. All mutated amino acid residues within the spike protein are shown. Specific condition (concentration in μg/ml) of the well that was selected for sequencing is shown in the left-hand column (refer to FIG. 18B for an outline of the assay design). Percentage in each box identifies % of sequencing reads that contained the respective mutant sequence. Sample 10989/87 was not sequenced from passage 2 due to undetectable CPE in virus-only control well.

FIG. 20 displays neutralization potency of individual anti-spike antibodies and antibody combinations against pseudoparticles encoding individual escape mutants. Escape mutations identified by RNAseq analysis within the RDB domain were cloned and expressed on pseudoparticles to assess their impact on mAb neutralization potency. Reduction in IC50 less than 1 log can be seen in mAb combination conditions where one of the mAbs has no potency (ex: K444Q and mAb10933/mAb10987). NC=IC50 could not be calculated due to poor neutralization ability.

FIG. 22 displays the ability of combinations of antibodies to reduce the frequency of escape over individual antibodies, as well as that certain combinations also can reduce the frequency of escape even over other combinations. Complete escape was observed with mAb10933 after 2 passages, with mAb10987 after 3 passages, and with mAb10985 after 1 passage. However, mAb10933+mAb10987 pushed out complete escape to 7 passages, and no escape was observed with mAb10933+mAb10987+mAb10985 even after 11 passages. P1=passage 1, P2=passage 2, and so on.

FIG. 23A and FIG. 23B: FIG. 23A displays neutralization curves and FIG. 23B displays neutralization fold-decrease relative to parental D614G variant. Full UK B.1.1.7 (H69del, V70del, Y145del, N501Y, A570D, D614G, P681H, T716I, S982A, D1118H), and South African B.1.351 (D80Y, D215Y, L241del, L242del, A243del, L242del, K417N, E484K, N501Y, D614G, A701V) variants were assessed. Key RBD residues from California B.1.429 (L452R) and Brazil P.1 (E484K/K417T) variants were assessed. The E484K variant has been identified in many global lineages, including the New York B.1.526 lineage.

FIG. 24A, FIG. 24B, FIG. 24C, and FIG. 24D display in vitro escape with individual antibodies and antibody combinations. VSV-spike recombinant virus was passaged under pressure of individual antibodies or antibody combinations. FIG. 24A: the passage number during which the virus completely escaped neutralizing activity of the antibodies as evidenced by the cytopathic effect (CPE), is shown as "complete escape" for wells where antibody concentration was 10 μg/ml or above or "partial escape" for wells where antibody concentration was 1-10 ug/ml. FIG. 24B: mutations in spike protein identified through RNAseq analysis of supernatants from wells with complete escape selected under each antibody condition are listed in the table. The frequency of each mutation from total viral reads at that amino acid position is listed in prentices. Only those mutations that were present at frequencies above 15% are shown as more minor variants are unlikely to contribute to complete escape. * The COV2-2130+COV2-2196 combination was only passaged for three passages and retained its neutralization potency through passage three. FIG. 24C: Neutralization potency of the two mAb REGN10987+REGN10933 combination and the three mAb REGN10987+REGN10933+REGN10985 combination along with individual mAbs. FIG. 24D: two views of the RBD-REGN10933-REGN10987-REGN10985 model.

FIG. 25A: study design. FIG. 25B and FIG. 25C: graphs show the distribution and frequencies of amino acid variants across the spike protein sequence identified in samples from the (FIG. 25B) prophylactic or (FIG. 25C) treated groups. Mutated sites are indicated with grey lines and dots show the frequency of variants in each animal. All amino acid changes in RBD are labeled.

FIG. 26A: arrows highlight variants identified in 1 or more samples from at least one patient. FIG. 26B: arrows highlight variants identified in 2 or more samples from at least one patient.

FIG. 27A: N501T and FIG. 27B: K537R variant frequencies are indicated by the black line as percent of reads with nSNPs relative to total number of covering reads. Histograms show total and mutated read coverage at variant position.

FIG. 28A: arrows highlight variants identified in 1 or more samples from at least one patient. FIG. 28B: arrows highlight variants identified in 2 or more samples from at least one patient.

FIG. 29A, FIG. 29B-1, and FIG. 29B-2: viral load and longitudinal frequencies of variants in SARS-CoV-2 positive samples from non-hospitalized patients. Viral load was determined by quantitative RT-PCR. FIG. 29A: S494P, and FIG. 29B: G446V and variant frequencies are indicated by the black line as percent of reads with nSNPs relative to total number of covering reads. Histograms show total and mutated read coverage at variant position.

FIG. 30 displays statistics on sequenced data for each clinical group from two clinical studies (study 2066 and study 2067). The table shown in the figure includes the patient, sample and amino acid change counts for each study.

FIG. 33A and FIG. 33B display neutralization curves and neutralization fold-decrease relative to parental D614G variant. G446V, S477N, N501Y, S494P, and K537R variants were assessed. The N501Y variant was used to substitute for N501T.

FIG. 34 shows relative neutralization potency of REGEN-COV combination and individual antibodies against spike protein variants identified in hamster lungs. Decrease in neutralization potency relative to the parental virus is shown for each variant identified through RNAseq analysis of hamster lung RNA. In cases where neutralization potency was not available (N/A) with the exact variant identified in infected hamsters, data is shown for an alternative variant at same position.

DETAILED DESCRIPTION OF THE INVENTION

Figure 2:
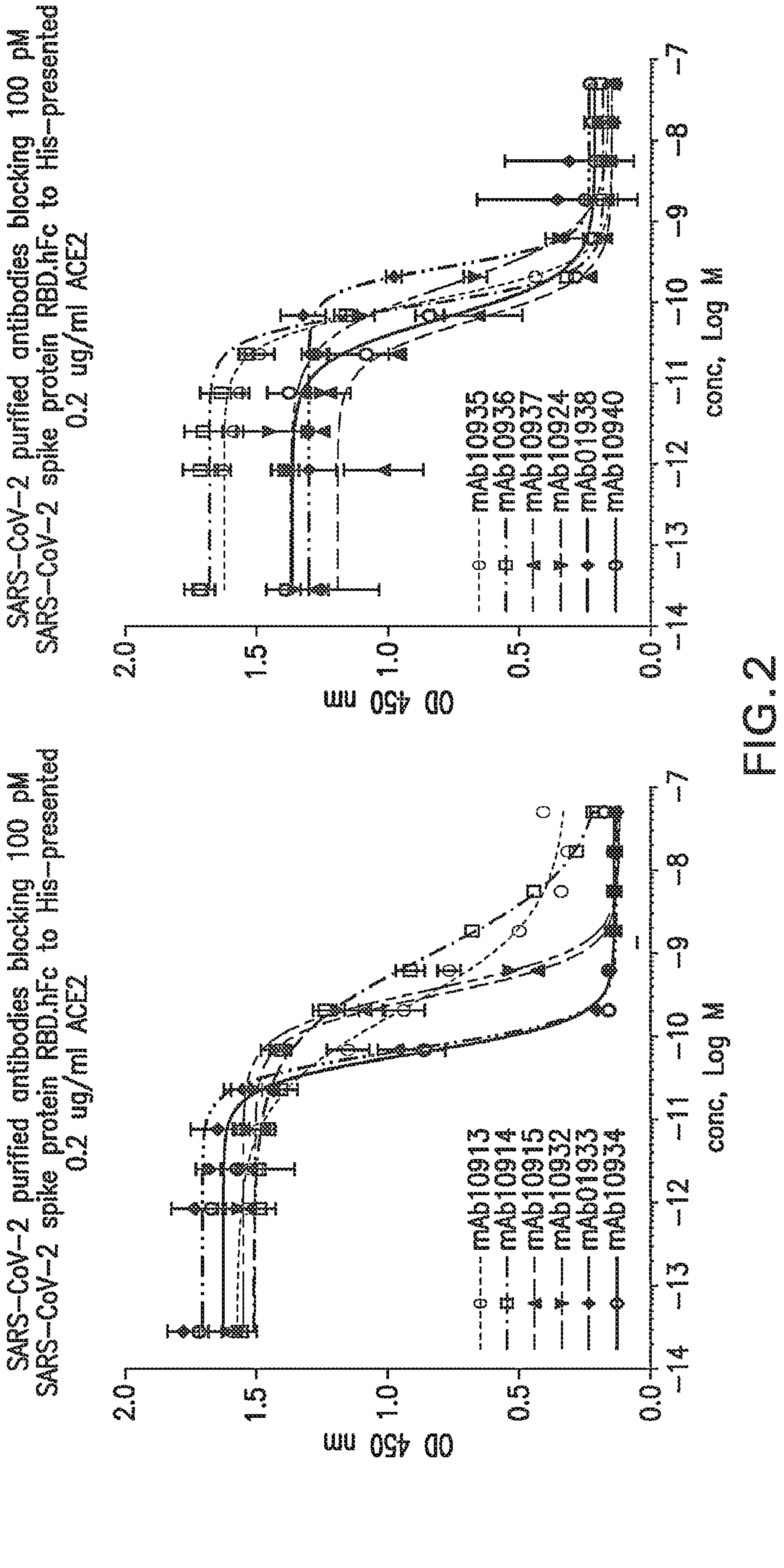
FIG. 2 shows ELISA blocking data for selected anti-SARS-CoV-2-S antibodies against SARS-CoV-2 spike protein, preventing the spike protein from binding to its receptor ACE2.
Figure 3:
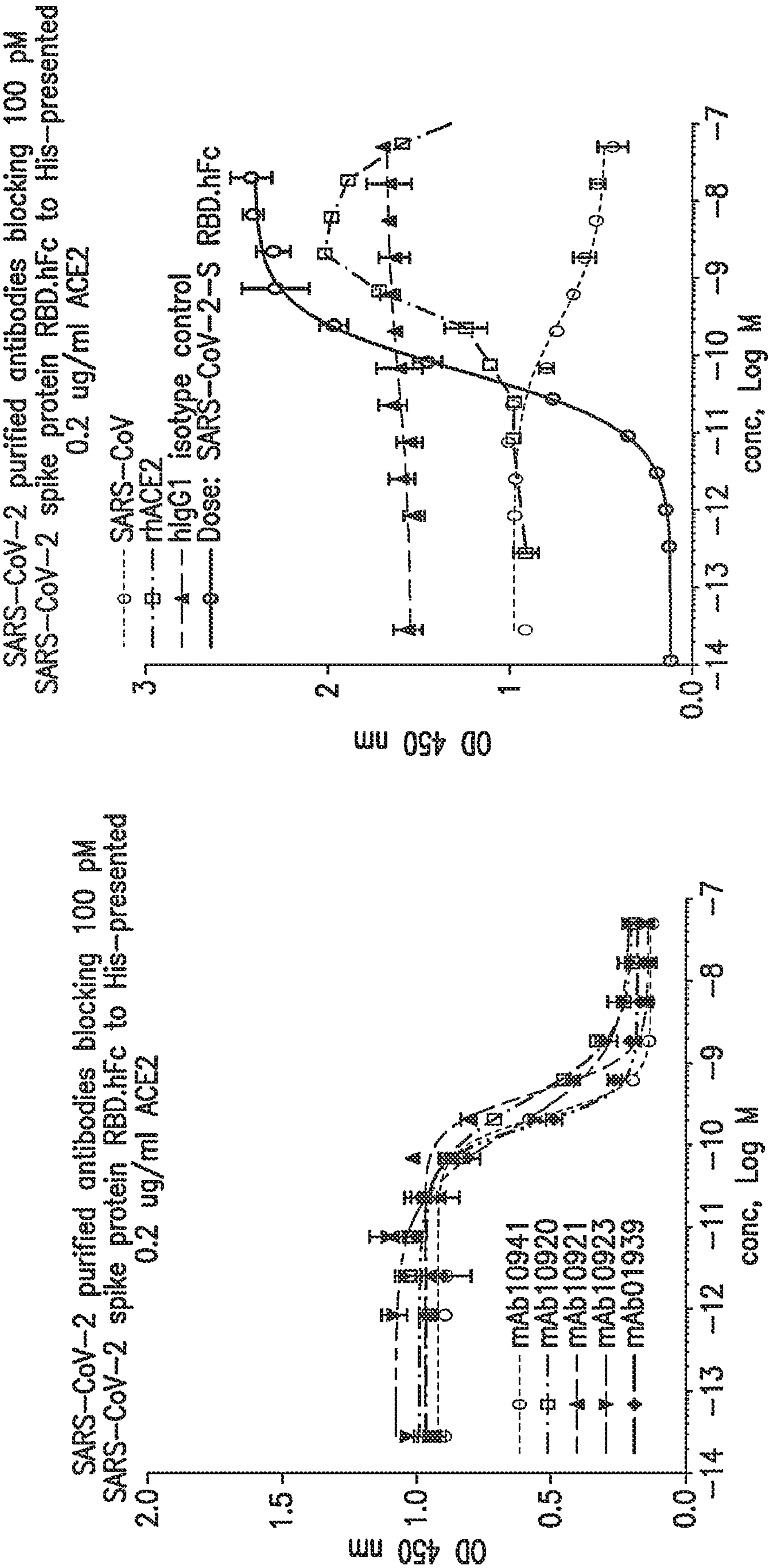
FIG. 3 shows ELISA blocking data for selected anti-SARS-CoV-2-S antibodies against SARS-CoV-2 spike protein, preventing the spike protein from binding to its receptor ACE2.
Figure 4:
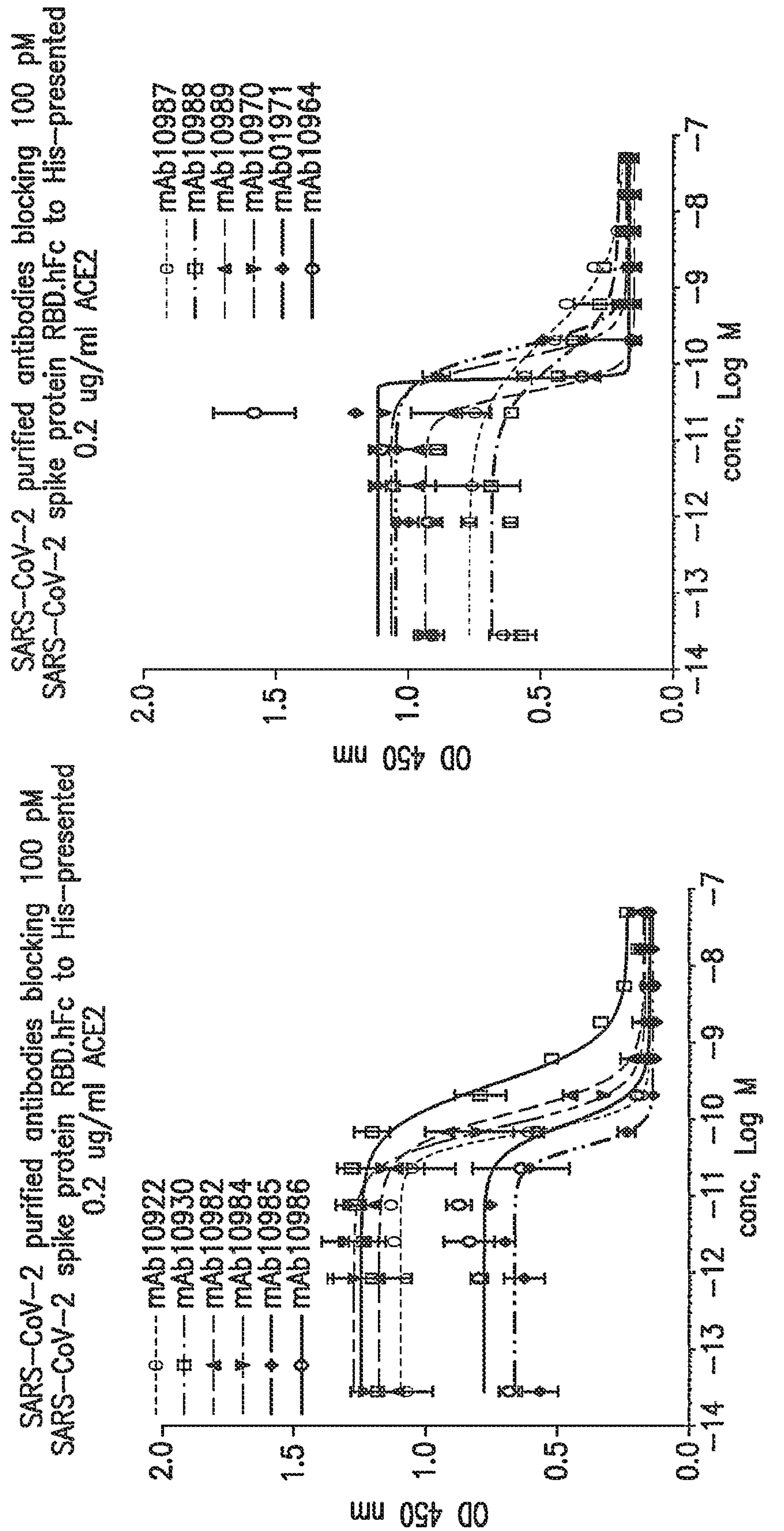
FIG. 4 shows ELISA blocking data for selected anti-SARS-CoV-2-S antibodies against SARS-CoV-2 spike protein, preventing the spike protein from binding to its receptor ACE2.
Figure 5:
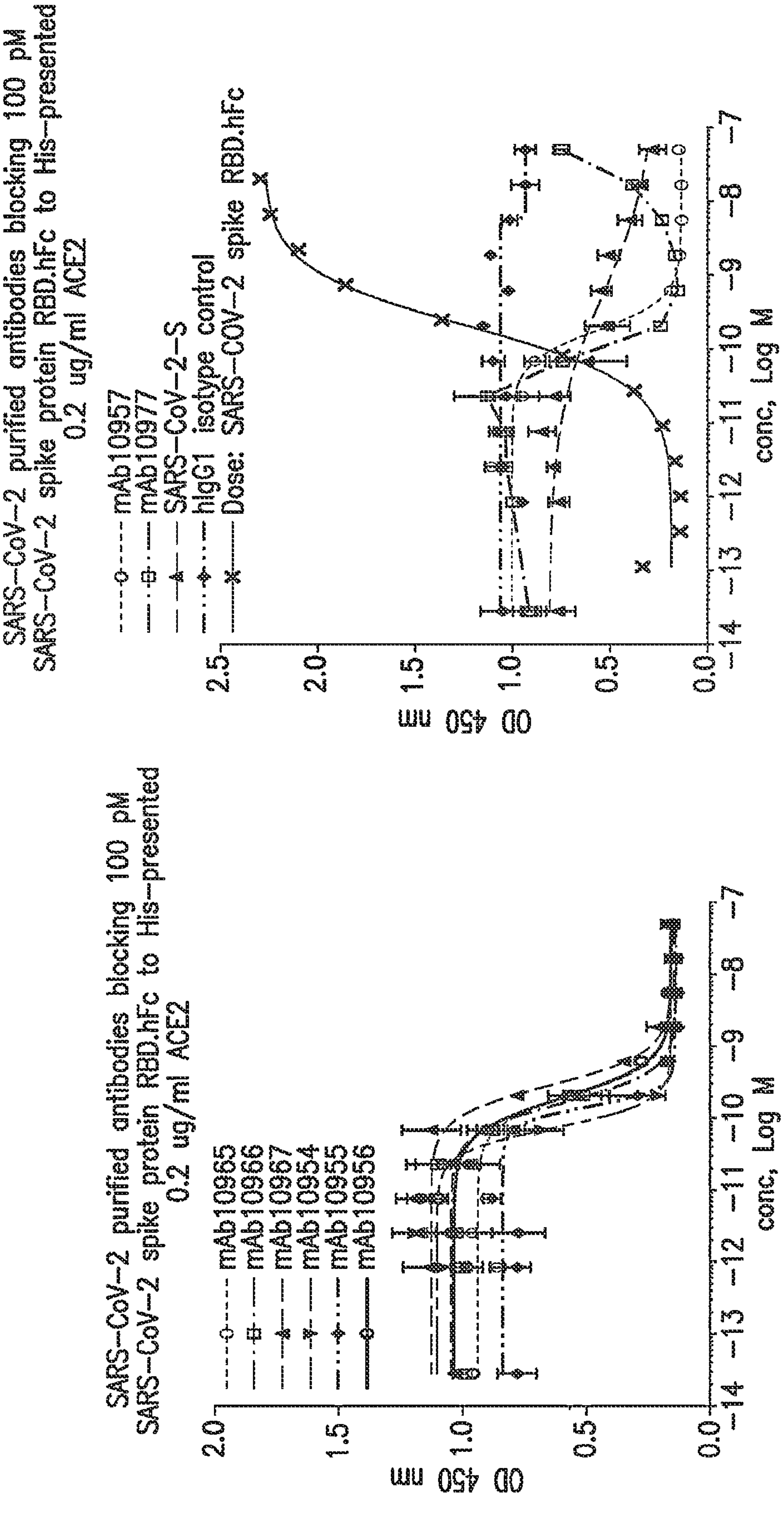
FIG. 5 shows ELISA blocking data for selected anti-SARS-CoV-2-S antibodies against SARS-CoV-2 spike protein, preventing the spike protein from binding to its receptor ACE2.
Figure 6:
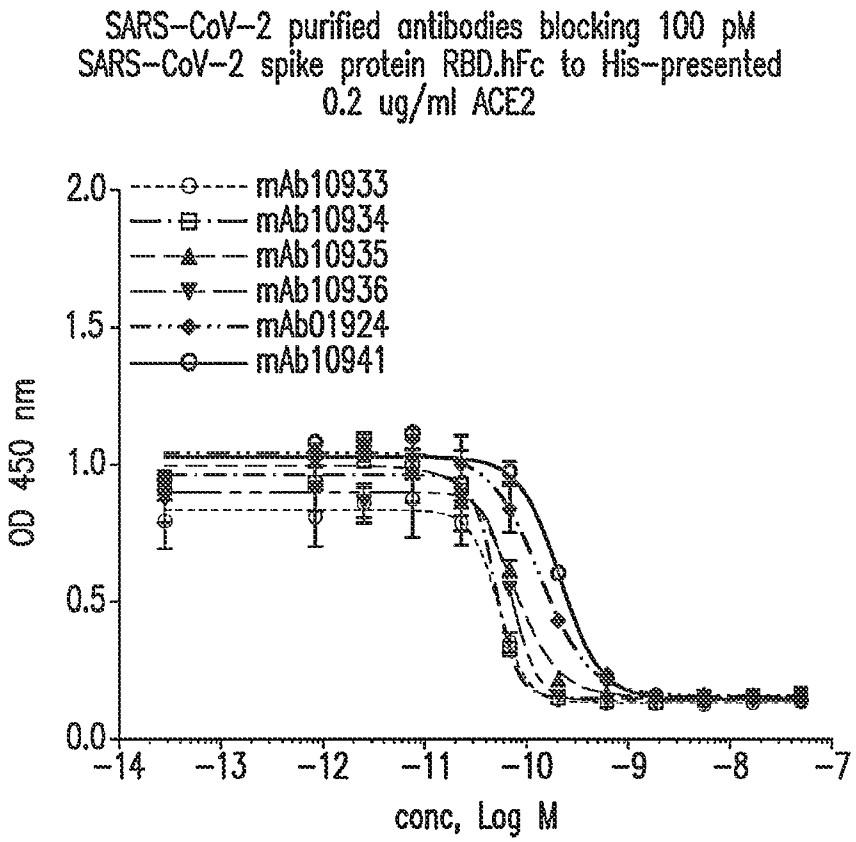
FIG. 6 shows ELISA blocking data for selected anti-SARS-CoV-2-S antibodies against SARS-CoV-2 spike protein, preventing the spike protein from binding to its receptor ACE2.
Figure 7:
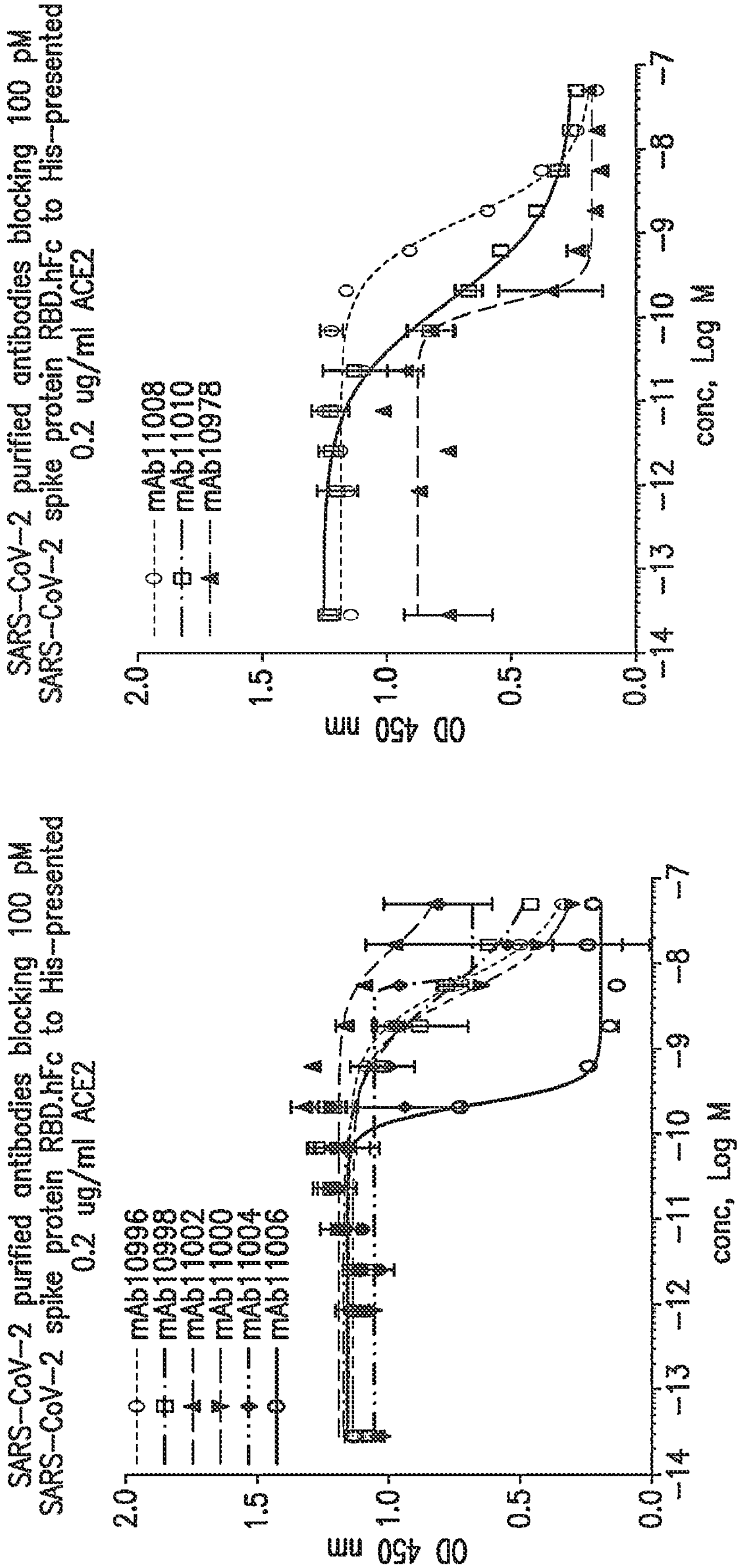
FIG. 7 shows ELISA blocking data for selected anti-SARS-CoV-2-S antibodies against SARS-CoV-2 spike protein, preventing the spike protein from binding to its receptor ACE2.
Figure 8:
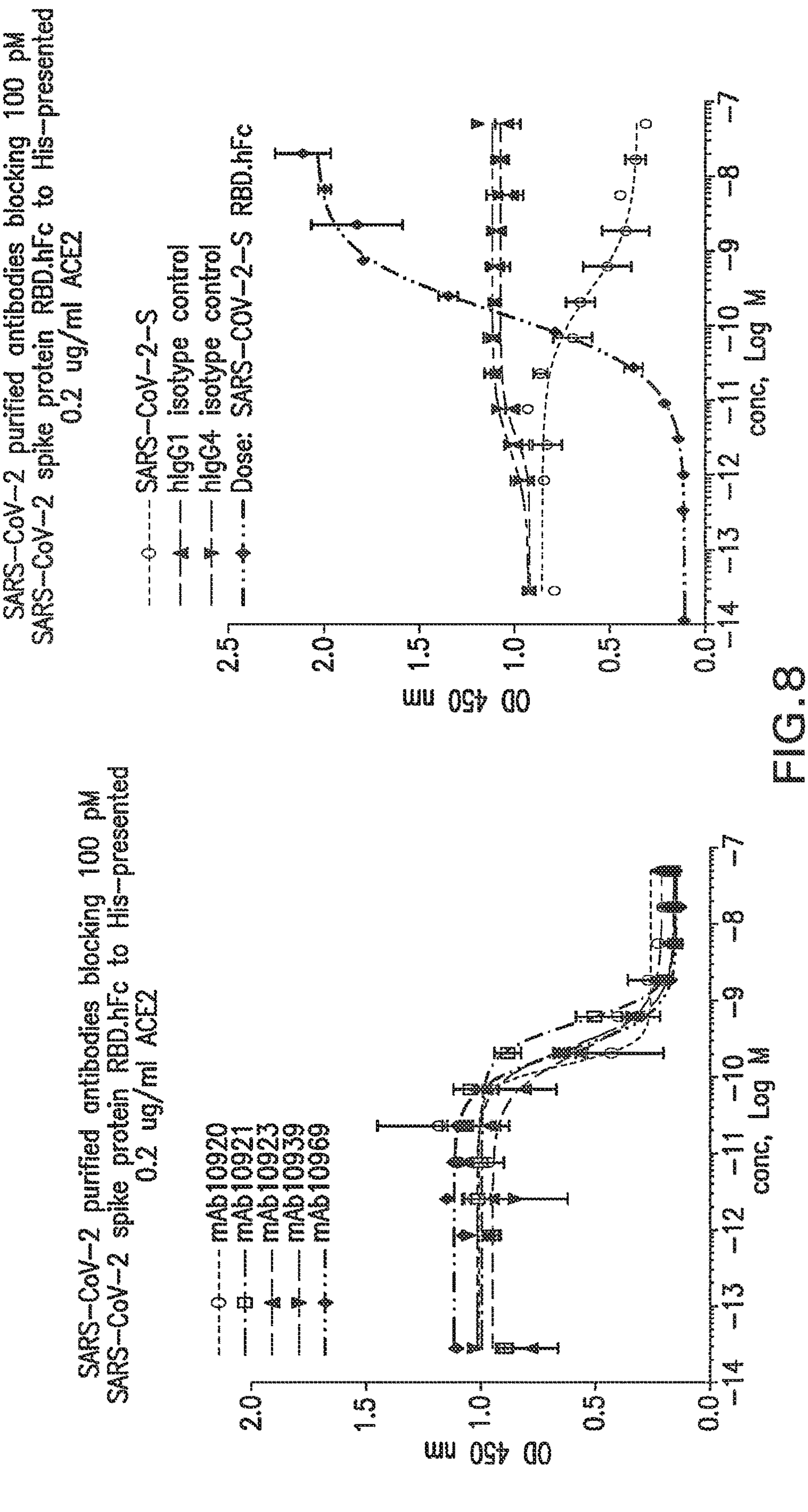
FIG. 8 shows ELISA blocking data for selected anti-SARS-CoV-2-S antibodies against SARS-CoV-2 spike protein, preventing the spike protein from binding to its receptor ACE2.
Figure 9:
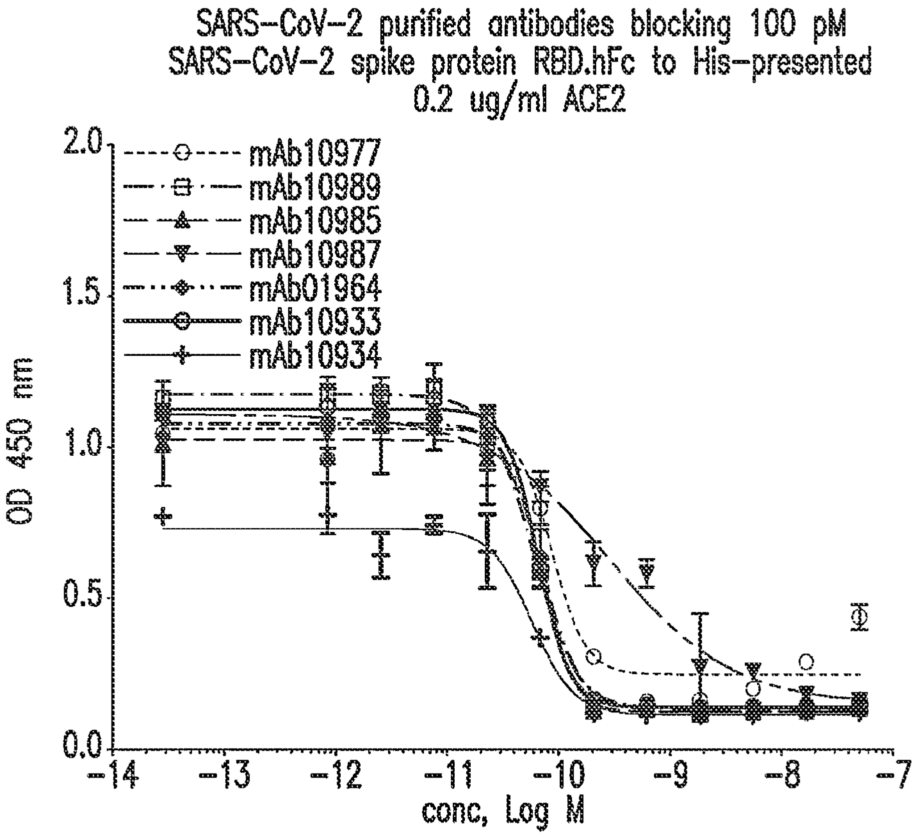
FIG. 9 shows ELISA blocking data for selected anti-SARS-CoV-2-S antibodies against SARS-CoV-2 spike protein, preventing the spike protein from binding to its receptor ACE2.

Before the present methods are described, it is to be understood that this invention is not limited to particular methods, and experimental conditions described, as such methods and conditions may vary. It is also to be understood that the terminology used herein is for the purpose of describing particular embodiments only, and is not intended to be limiting, since the scope of the present invention will be limited only by the appended claims.

Unless defined otherwise, all technical and scientific terms used herein have the same meaning as commonly understood by one of ordinary skill in the art to which this invention belongs. Although any methods and materials similar or equivalent to those described herein can be used in the practice or testing of the present invention, preferred methods and materials are now described. All publications mentioned herein are incorporated herein by reference in their entirety.

The term “coronavirus” or “CoV” refers to any virus of the coronavirus family, including but not limited to SARS-CoV-2, MERS-CoV, and SARS-CoV. SARS-CoV-2 refers to the newly-emerged coronavirus which was identified as the cause of a serious outbreak starting in Wuhan, China, and which is rapidly spreading to other areas of the globe. SARS-CoV-2 has also been known as 2019-nCoV and Wuhan coronavirus. It binds via the viral spike protein to human host cell receptor angiotensin-converting enzyme 2 (ACE2). The spike protein also binds to and is cleaved by TMPRSS2, which activates the spike protein for membrane fusion of the virus.

The term “CoV-S”, also called “S” or “S protein” refers to the spike protein of a coronavirus, and can refer to specific S proteins such as SARS-CoV-2-S, MERS-CoV S, and SARS-CoV S. The SARS-CoV-2-Spike protein is a 1273 amino acid type I membrane glycoprotein which assembles into trimers that constitute the spikes or peplomers on the surface of the enveloped coronavirus particle. The protein has two essential functions, host receptor binding and membrane fusion, which are attributed to the N-terminal (S1) and C-terminal (S2) halves of the S protein. CoV-S binds to its cognate receptor via a receptor binding domain (RBD) present in the S1 subunit. The amino acid sequence of full-length SARS-CoV-2 spike protein is exemplified by the amino acid sequence provided in SEQ ID NO: 832. The term “CoV-S” includes protein variants of CoV spike protein isolated from different CoV isolates as well as recombinant CoV spike protein or a fragment thereof. The term also encompasses CoV spike protein or a fragment thereof coupled to, for example, a histidine tag, mouse or human Fc, or a signal sequence such as ROR1.

The term “coronavirus infection” or “CoV infection,” as used herein, refers to infection with a coronavirus such as SARS-CoV-2, MERS-CoV, or SARS-CoV. The term includes coronavirus respiratory tract infections, often in the lower respiratory tract. Symptoms can include high fever, dry cough, shortness of breath, pneumonia, gastro-intestinal symptoms such as diarrhea, organ failure (kidney failure and renal dysfunction), septic shock, and death in severe cases.

Viruses

The present invention includes methods for treating or preventing a viral infection in a subject. The term “virus” includes any virus whose infection in the body of a subject is treatable or preventable by administration of an anti-CoV-S antibody or antigen-binding fragment thereof (e.g., wherein infectivity of the virus is at least partially dependent on CoV-S). In an embodiment of the invention, a “virus” is any virus that expresses spike protein (e.g., CoV-S). The term “virus” also includes a CoV-S-dependent respiratory virus which is a virus that infects the respiratory tissue of a subject (e.g., upper and/or lower respiratory tract, trachea, bronchi, lungs) and is treatable or preventable by administration of an anti-CoV-S antibody or antigen-binding fragment thereof. For example, in an embodiment of the invention, virus includes coronavirus, SARS-CoV-2 (severe acute respiratory syndrome coronavirus 2), SARS-CoV (severe acute respiratory syndrome coronavirus), and MERS-CoV (Middle East respiratory syndrome (MERS) coronavirus). Coronaviruses can include the genera of alphacoronaviruses, betacoronaviruses, gammacoronaviruses, and deltacoronaviruses. In some embodiments, the antibodies or antigen-binding fragments provided herein can bind to and/or neutralize an alphacoronavirus, a betacoronavirus, a gammacoronavirus, and/or a deltacoronavirus. In certain embodiments, this binding and/or neutralization can be specific for a particular genus of coronavirus or for a particular subgroup of a genus. “Viral infection” refers to the invasion and multiplication of a virus in the body of a subject.

Coronavirus virions are spherical with diameters of approximately 125 nm. The most prominent feature of coronaviruses is the club-shape spike projections emanating from the surface of the virion. These spikes are a defining feature of the virion and give them the appearance of a solar corona, prompting the name, coronaviruses. Within the envelope of the virion is the nucleocapsid. Coronaviruses have helically symmetrical nucleocapsids, which is uncommon among positive-sense RNA viruses, but far more common for negative-sense RNA viruses. SARS-CoV-2, MERS-CoV, and SARS-CoV belong to the coronavirus family. The initial attachment of the virion to the host cell is initiated by interactions between the S protein and its receptor. The sites of receptor binding domains (RBD) within the S1 region of a coronavirus S protein vary depending on the virus, with some having the RBD at the C-terminus of S1. The S-protein/receptor interaction is the primary determinant for a coronavirus to infect a host species and also governs the tissue tropism of the virus. Many coronaviruses utilize peptidases as their cellular receptor. Following receptor binding, the virus must next gain access to the host cell cytosol. This is generally accomplished by acid-dependent proteolytic cleavage of S protein by a cathepsin, TMPRRS2 or another protease, followed by fusion of the viral and cellular membranes.

Anti-CoV-S Antibodies and Antigen-Binding Fragments

The present invention provides antigen-binding proteins, such as antibodies and antigen-binding fragments thereof, that specifically bind to CoV spike protein or an antigenic fragment thereof.

The term "antibody", as used herein, refers to immunoglobulin molecules comprising four polypeptide chains, two heavy chains (HCs) and two light chains (LCs) inter-connected by disulfide bonds (i.e., "full antibody molecules"), as well as multimers thereof (e.g. IgM). Exemplary antibodies include, for example, those listed in Table 1. Each heavy chain comprises a heavy chain variable region ("HCVR" or "$V_H$") and a heavy chain constant region (comprised of domains $C_H1$, $C_H2$ and $C_H3$). Each light chain is comprised of a light chain variable region ("LCVR or "$V_L$") and a light chain constant region ($C_L$). The $V_H$ and $V_L$ regions can be further subdivided into regions of hypervariability, termed complementarity determining regions (CDR), interspersed with regions that are more conserved, termed framework regions (FR). Each $V_H$ and $V_L$ comprises three CDRs and four FRs, arranged from amino-terminus to carboxy-terminus in the following order: FR1, CDR1, FR2, CDR2, FR3, CDR3, FR4. Heavy chain CDRs can also be referred to as HCDRs or CDR-Hs, and numbered as described above (e.g., HCDR1, HCDR2, and HCDR3 or CDR-H1, CDR-H2, and CDR-H3). Likewise, light chain CDRs can be referred to as LCDRs or CDR-Ls, and numbered LCDR1, LCDR2, and LCDR3, or CDR-L1, CDR-L2, and CDR-L3. In certain embodiments of the invention, the FRs of the antibody (or antigen binding fragment thereof) are identical to the human germline sequences, or are naturally or artificially modified. Exemplary human germline sequences include, but are not limited to, VH3-66 and Vk1-33. Thus, the present disclosure provides anti-CoV-S antibodies or antigen-binding fragments thereof (e.g., anti-SARS-CoV-2-S antibodies or antigen-binding fragments thereof) comprising HCDR and LCDR sequences of Table 1 within a VH3-66 or Vk1-33 variable heavy chain region. Monoclonal antibodies herein can be designated by "mAb" followed by a number (e.g., mAb10933) or by "REGN" then a number (e.g., REGN10933). It is to be understood that "mAb" and "REGN" can be used interchangeable (e.g., mAb10933 is the same antibody as REGN10933).

Typically, the variable domains of both the heavy and light immunoglobulin chains comprise three hypervariable regions, also called complementarity determining regions (CDRs), located within relatively conserved framework regions (FR). In general, from N-terminal to C-terminal, both light and heavy chains variable domains comprise FR1, CDR1, FR2, CDR2, FR3, CDR3 and FR4. In an embodiment of the invention, the assignment of amino acids to each domain is in accordance with the definitions of Sequences of Proteins of Immunological Interest, Kabat, et al.; National Institutes of Health, Bethesda, Md.; $5^{th}$ ed.; NIH Publ. No. 91-3242 (1991); Kabat (1978) Adv. Prot. Chem. 32:1-75; Kabat, et al., (1977) J. Biol. Chem. 252:6609-6616; Chothia, et al., (1987) J Mol. Biol. 196:901-917 or Chothia, et al., (1989) Nature 342:878-883.

The present invention includes monoclonal anti-CoV-S antigen-binding proteins, e.g., antibodies and antigen-binding fragments thereof, as well as monoclonal compositions comprising a plurality of isolated monoclonal antigen-binding proteins. The term "monoclonal antibody", as used herein, refers to a population of substantially homogeneous antibodies, i.e., the antibody molecules comprising the population are identical in amino acid sequence except for possible naturally occurring mutations that may be present in minor amounts. A "plurality" of such monoclonal antibodies and fragments in a composition refers to a concentration of identical (i.e., as discussed above, in amino acid sequence except for possible naturally occurring mutations that may be present in minor amounts) antibodies and fragments which is above that which would normally occur in nature, e.g., in the blood of a host organism such as a mouse or a human.

In an embodiment of the invention, an anti-CoV-S antigen-binding protein, e.g., antibody or antigen-binding fragment comprises a heavy chain constant domain, e.g., of the type IgA (e.g., IgA1 or IgA2), IgD, IgE, IgG (e.g., IgG1, IgG2, IgG3 and IgG4) or IgM. In an embodiment of the invention, an antigen-binding protein, e.g., antibody or antigen-binding fragment comprises a light chain constant domain, e.g., of the type kappa or lambda.

The term "human" antigen-binding protein, such as an antibody, as used herein, includes antibodies having variable and constant regions derived from human germline immunoglobulin sequences whether in a human cell or grafted into a non-human cell, e.g., a mouse cell. See e.g., U.S. Pat. Nos. 8,502,018, 6,596,541 or 5,789,215. The human mAbs of the invention may include amino acid residues not encoded by human germline immunoglobulin sequences (e.g., mutations introduced by random or site-specific mutagenesis in vitro or by somatic mutation in vivo), for example in the CDRs and, in particular, CDR3. However, the term "human antibody", as used herein, is not intended to include mAbs in which CDR sequences derived from the germline of another mammalian species (e.g., mouse) have been grafted onto human FR sequences. The term includes antibodies recombinantly produced in a non-human mammal or in cells of a non-human mammal. The term is not intended to include antibodies isolated from or generated in a human subject. See below.

The present invention includes anti-CoV-S chimeric antigen-binding proteins, e.g., antibodies and antigen-binding fragments thereof, and methods of use thereof. As used herein, a "chimeric antibody" is an antibody having the variable domain from a first antibody and the constant domain from a second antibody, where the first and second antibodies are from different species. (U.S. Pat. No. 4,816,567; and Morrison et al., (1984) Proc. Natl. Acad. Sci. USA 81: 6851-6855).

The term "recombinant" antigen-binding proteins, such as antibodies or antigen-binding fragments thereof, refers to such molecules created, expressed, isolated or obtained by technologies or methods known in the art as recombinant DNA technology which include, e.g., DNA splicing and transgenic expression. The term includes antibodies expressed in a non-human mammal (including transgenic non-human mammals, e.g., transgenic mice), or a cell (e.g., CHO cells) expression system or isolated from a recombinant combinatorial human antibody library. In some embodiments, a recombinant antibody shares a sequence with an antibody isolated from an organism (e.g., a mouse or a human), but has been expressed via recombinant DNA technology. Such antibodies may have post-translational modifications (e.g., glycosylation) that differ from the antibody as isolated from the organism.

In some embodiments, the antibodies disclosed herein lack fucose in its constant region glycosylation. Methods of measuring fucose in an antibody composition have been described in the art, e.g., U.S. Pat. No. 8,409,838 (Regeneron Pharmaceuticals), incorporated herein by reference. In some embodiments, fucose is undetectable in a composition comprising a population of antibody molecules. In some embodiments, an antibody lacking fucose has enhanced ADCC activity.

In some embodiments, antibodies that lack fucose can be produced using cell lines that are deficient in their ability to fucosylate proteins, i.e., the ability to fucosylate proteins is reduced or eliminated. Fucosylation of glycans requires synthesis of GDP-fucose via the de novo pathway or the salvage pathway, both of which involve sequential function of several enzymes, leading to addition of a fucose molecule to the first N-acetylglucosamine (GlcNAc) moiety of the reducing end of a glycan. The two key enzymes of the de novo pathway responsible for production of GDP-fucose are GDP-D-mannose-4,6-dehydratase (GMD) and GDP-keto-6-deoxymannose-3,5-epimerase,4-reductase (FX). In the absence of fucose, these two de novo pathway enzymes (GMD and FX) convert mannose and/or glucose to GDP-fucose which is then transported into the Golgi complex where nine fucosyl-transferases (FUT1-9) act in concert to fucosylate the first GlcNAc molecule of a glycan. In the presence of fucose, however, the salvage pathway enzymes, fucose-kinase and GDP-fucose pyrophosphorylase, convert fucose into GDP-fucose.

Cell lines that are deficient in their ability to fucosylate proteins have been described in the art. In some embodiments, a cell line deficient in its ability to fucosylate proteins is a mammalian cell line (e.g., CHO cell lines, such as CHO K1, DXB-11 CHO, Veggie-CHO) comprising a mutation or genetic modification in one or more of endogenous FUT1 to 9 genes resulting in a lack of one or more functional fucosyl-transferases. In some embodiments, the mammalian cell line comprises a mutation in an endogenous FUT8 gene (e.g., a FUT8 knock-out cell line in which the FUT8 gene has been disrupted resulting in a lack of a functional a1,6-fucosyltransferase in the cell line, as described in U.S. Pat. No. 7,214,775 (Kyowa Hakko Kogyo Co., Ltd.) and U.S. Pat. No. 7,737,725 (Kyowa Hakko Kirin Co., Ltd), incorporated herein by reference. In some embodiments, the mammalian cell line comprises a mutation or genetic modification in an endogenous GMD gene resulting in a lack of a functional GMD in the cell line, e.g., a GMD knock-out cell line in which the GMD gene has been disrupted, described in e.g., U.S. Pat. No. 7,737,725 (Kyowa Hakko Kirin Co., Ltd), incorporated herein by reference. In some embodiments, the mammalian cell line comprises a mutation or genetic modification in an endogenous Fx gene resulting in a lack of a functional Fx protein. In some embodiments, the mammalian cell line is an Fx knock-out cell line in which the endogenous Fx gene has been disrupted (see, e.g., U.S. Pat. No. 7,737,725 (Kyowa Hakko Kirin Co., Ltd), incorporated herein by reference). In some embodiments, the mammalian cell line comprises a mutation in an endogenous Fx mutation that confers temperature sensitive phenotypes (as described in, e.g., U.S. Pat. No. 8,409,838 (Regeneron Pharmaceuticals), incorporated herein by reference). In some embodiments, the mammalian cell line deficient in its ability to fucosylate proteins is a cell line that has been selected based on resistance to certain lectins, e.g., the *Lens culinaris* lectin. See, e.g., U.S. Pat. No. 8,409,838 (Regeneron Pharmaceuticals), incorporated herein by reference.

Recombinant anti-CoV-S antigen-binding proteins, e.g., antibodies and antigen-binding fragments, disclosed herein may also be produced in an *E. coli*/T7 expression system. In this embodiment, nucleic acids encoding the anti-CoV-S antibody immunoglobulin molecules of the invention (e.g., as found in Table 1) may be inserted into a pET-based plasmid and expressed in the *E. coli*/T7 system. For example, the present invention includes methods for expressing an antibody or antigen-binding fragment thereof or immunoglobulin chain thereof in a host cell (e.g., bacterial host cell such as *E. coli* such as BL21 or BL21DE3) comprising expressing T7 RNA polymerase in the cell which also includes a polynucleotide encoding an immunoglobulin chain that is operably linked to a T7 promoter. For example, in an embodiment of the invention, a bacterial host cell, such as an *E. coli*, includes a polynucleotide encoding the T7 RNA polymerase gene operably linked to a lac promoter and expression of the polymerase and the chain is induced by incubation of the host cell with IPTG (isopropyl-beta-D-thiogalactopyranoside). See U.S. Pat. Nos. 4,952,496 and 5,693,489 or Studier & Moffatt, Use of bacteriophage T7 RNA polymerase to direct selective high-level expression of cloned genes, J. Mol. Biol. 1986 May 5; 189(1): 113-30.

There are several methods by which to produce recombinant antibodies which are known in the art. One example of a method for recombinant production of antibodies is disclosed in U.S. Pat. No. 4,816,567.

Transformation can be by any known method for introducing polynucleotides (e.g., DNA or RNA, including mRNA) into a host cell. Methods for introduction of heterologous polynucleotides into mammalian cells are well known in the art and include dextran-mediated transfection, calcium phosphate precipitation, polybrene-mediated transfection, protoplast fusion, electroporation, encapsulation of the polynucleotide(s) in liposomes, lipid nanoparticle technology, biolistic injection and direct microinjection of the DNA into nuclei. In addition, nucleic acid molecules may be introduced into mammalian cells by viral vectors such as lentivirus or adeno-associated virus. Methods of transforming cells are well known in the art. See, for example, U.S. Pat. Nos. 4,399,216; 4,912,040; 4,740,461 and 4,959,455. In some embodiments, an antibody or antigen-binding fragment thereof of the present disclosure can be introduced to a subject in nucleic acid form (e.g, DNA or RNA, including mRNA), such that the subject's own cells produce the antibody. The present disclosure further provides modifications to nucleotide sequences encoding the anti-CoV-S antibodies described herein that result in increased antibody expression, increased antibody stability, increased nucleic acid (e.g., mRNA) stability, or improved affinity or specificity of the antibodies for the CoV spike protein.

Thus, the present invention includes recombinant methods for making an anti-CoV-S antigen-binding protein, such as an antibody or antigen-binding fragment thereof of the present invention, or an immunoglobulin chain thereof, comprising (i) introducing one or more polynucleotides (e.g., including the nucleotide sequence of any one or more of the sequences of Table 2) encoding light and/or heavy immunoglobulin chains, or CDRs, of the antigen-binding protein, e.g., of Table 1, for example, wherein the polynucleotide is in a vector; and/or integrated into a host cell chromosome and/or is operably linked to a promoter; (ii) culturing the host cell (e.g., CHO or *Pichia* or *Pichia pastoris*) under condition favorable to expression of the polynucleotide and, (iii) optionally, isolating the antigen-binding protein, (e.g., antibody or fragment) or chain from the host cell and/or medium in which the host cell is grown. For example, a polynucleotide can be integrated into a host cell chromosome through targeted insertion with a vector such as adeno-associated virus (AAV), e.g., after cleavage of the chromosome using a gene editing system (e.g., CRISPR (for example, CRISPR-Cas9), TALEN, megaTAL, zinc finger, or Argonaute). Targeted insertions can take place, for example, at host cell loci such as an albumin or immunoglobulin genomic locus. Alternatively, insertion can be at a random locus, e.g., using a vector such as lentivirus. When making an antigen-binding protein (e.g., antibody or antigen-binding fragment) comprising more than one immunoglobulin chain, e.g., an antibody that comprises two heavy immunoglobulin chains and two light immunoglobulin chains, co-expression of the chains in a single host cell leads to association of the chains, e.g., in the cell or on the cell surface or outside the cell if such chains are secreted, so as to form the antigen-binding protein (e.g., antibody or antigen-binding fragment). The methods include those wherein only a heavy immunoglobulin chain or only a light immunoglobulin chain (e.g., any of those discussed herein including mature fragments and/or variable domains thereof) is expressed. Such chains are useful, for example, as intermediates in the expression of an antibody or antigen-binding fragment that includes such a chain. For example, the present invention also includes anti-CoV-S antigen-binding proteins, such as antibodies and antigen-binding fragments thereof, comprising a heavy chain immunoglobulin (or variable domain thereof or comprising the CDRs thereof) encoded by a polynucleotide comprising a nucleotide sequence set forth in Table 2 and a light chain immunoglobulin (or variable domain thereof or comprising the CDRs thereof) encoded by a nucleotide sequence set forth in Table 2 which are the product of such production methods, and, optionally, the purification methods set forth herein. For example, in some embodiments, the product of the method is an anti-CoV-S antigen-binding protein which is an antibody or fragment comprising an HCVR comprising an amino acid sequence set forth in Table 1 and an LCVR comprising an amino acid sequence set forth in Table 1, wherein the HCVR and LCVR sequences are selected from a single antibody listed in Table 1. In some embodiments, the product of the method is an anti-CoV-S antigen-binding protein which is an antibody or fragment comprising HCDR1, HCDR2, and HCDR3 comprising amino acid sequences set forth in Table 1 and LCDR1, LCDR2, and LCDR3 comprising amino acid sequences set forth in Table 1, wherein the six CDR sequences are selected from a single antibody listed in Table 1. In some embodiments, the product of the method is an anti-CoV-S antigen-binding protein which is an antibody or fragment comprising a heavy chain comprising an HC amino acid sequence set forth in Table 1 and a light chain comprising an LC amino acid sequence set forth in Table 1.

Eukaryotic and prokaryotic host cells, including mammalian cells, may be used as hosts for expression of an anti-CoV-S antigen-binding protein. Such host cells are well known in the art and many are available from the American Type Culture Collection (ATCC). These host cells include, inter alia, Chinese hamster ovary (CHO) cells, NS0, SP2 cells, HeLa cells, baby hamster kidney (BHK) cells, monkey kidney cells (COS), human hepatocellular carcinoma cells (e.g., Hep G2), A549 cells, 3T3 cells, HEK-293 cells and a number of other cell lines. Mammalian host cells include human, mouse, rat, dog, monkey, pig, goat, bovine, horse and hamster cells. Other cell lines that may be used are insect cell lines (e.g., *Spodoptera frugiperda* or *Trichoplusia ni*), amphibian cells, bacterial cells, plant cells and fungal cells. Fungal cells include yeast and filamentous fungus cells including, for example, *Pichia pastoris, Pichia finlandica, Pichia trehalophila, Pichia koclamae, Pichia membranaefaciens, Pichia minuta* (*Ogataea minuta, Pichia lindneri*), *Pichia opuntiae, Pichia thermotolerans, Pichia salictaria, Pichia guercuum, Pichia pijperi, Pichia stiptis, Pichia methanolica, Pichia* sp., *Saccharomyces cerevisiae, Saccharomyces* sp., *Hansenula polymorpha, Kluyveromyces* sp., *Kluyveromyces lactis, Candida albicans, Aspergillus nidulans, Aspergillus niger, Aspergillus oryzae, Trichoderma reesei, Chrysosporium lucknowense, Fusarium* sp., *Fusarium gramineum, Fusarium venenatum, Physcomitrella patens* and *Neurospora crassa*. The present invention includes an isolated host cell (e.g., a CHO cell) comprising an antigen-binding protein, such as those of Table 1; or a polynucleotide encoding such a polypeptide thereof.

The term "specifically binds" refers to those antigen-binding proteins (e.g., mAbs) having a binding affinity to an antigen, such as a CoV-S protein (e.g., SARS-CoV-2-S), expressed as $K_D$, of at least about $10^{-8}$ M, as measured by real-time, label free bio-layer interferometry assay, for example, at 25° C. or 37° C., e.g., an Octet® HTX biosensor, or by surface plasmon resonance, e.g., BIACORE™, or by solution-affinity ELISA. The present invention includes antigen-binding proteins that specifically bind to a CoV-S protein.

The terms "antigen-binding portion" or "antigen-binding fragment" of an antibody or antigen-binding protein, and the like, as used herein, include any naturally occurring, enzymatically obtainable, synthetic, or genetically engineered polypeptide or glycoprotein that specifically binds an antigen to form a complex. Non-limiting examples of antigen-binding fragments include: (i) Fab fragments; (ii) $F(ab)_2$ fragments; (iii) Fd fragments; (iv) Fv fragments; (v) single-chain Fv (scFv) molecules; (vi) dAb fragments; and (vii) minimal recognition units consisting of the amino acid residues that mimic the hypervariable region of an antibody (e.g., an isolated complementarity determining region (CDR) such as a CDR3 peptide), or a constrained FR3-CDR3-FR4 peptide. Other engineered molecules, such as domain-specific antibodies, single domain antibodies, domain-deleted antibodies, chimeric antibodies, CDR-grafted antibodies, diabodies, triabodies, tetrabodies, minibodies, nanobodies (e.g., as defined in WO08/020079 or WO09/138519) (e.g., monovalent nanobodies, bivalent nanobodies, etc.), small modular immunopharmaceuticals (SMIPs), and shark variable IgNAR domains, are also encompassed within the expression "antigen-binding fragment," as used herein. In an embodiment of the invention, the antigen-binding fragment comprises three or more CDRs of an antibody of Table 1 (e.g., CDR-H1, CDR-H2 and CDR-H3; or CDR-L1, CDR-L2 and CDR-L3).

An antigen-binding fragment of an antibody will, in an embodiment of the invention, comprise at least one variable domain. The variable domain may be of any size or amino acid composition and will generally comprise at least one CDR, which is adjacent to or in frame with one or more framework sequences. In antigen-binding fragments having a $V_H$ domain associated with a $V_L$ domain, the $V_H$ and $V_L$ domains may be situated relative to one another in any suitable arrangement. For example, the variable region may be dimeric and contain $V_H$-$V_H$, $V_H$-$V_L$ or $V_L$-$V_L$ dimers. Alternatively, the antigen-binding fragment of an antibody may contain a monomeric $V_H$ or $V_L$ domain.

In certain embodiments, an antigen-binding fragment of an antibody may contain at least one variable domain covalently linked to at least one constant domain. Non-limiting, exemplary configurations of variable and constant domains that may be found within an antigen-binding fragment of an antibody of the present invention include: (i) $V_H$-$C_H1$; (ii) $V_H$-$C_H2$; (iii) $V_H$-$C_H3$; (iv) $V_H$-$C_H1$-$C_H2$; (v) $V_H$-$C_H1$-$C_H2$-$C_H3$; (vi) $V_H$-$C_H2$-$C_H3$; (vii) $V_H$-$C_L$; (viii) $V_L$-$C_H1$; (ix) $V_L$-$C_H2$; (x) $V_L$-$C_H3$; (xi) $V_L$-$C_H1$-$C_H2$; (xii) $V_L$-$C_H1$-$C_H2$-$C_H3$; (xiii) $V_L$-$C_H2$-$C_H3$; and (xiv) $V_L$-$C_L$. In any configuration of variable and constant domains, including any of the exemplary configurations listed above, the variable and constant domains may be either directly linked to one another or may be linked by a full or partial hinge or linker region. A hinge region may consist of at least 2 (e.g., 5, 10, 15, 20, 40, 60 or more) amino acids, which result in a flexible or semi-flexible linkage between adjacent variable and/or constant domains in a single polypeptide molecule. Moreover, an antigen-binding fragment of an antibody of the present invention may comprise a homo-dimer or hetero-dimer (or other multimer) of any of the variable and constant domain configurations listed above in non-covalent association with one another and/or with one or more monomeric $V_H$ or $V_L$ domain (e.g., by disulfide bond(s)).

Antigen-binding proteins (e.g., antibodies and antigen-binding fragments) may be mono-specific or multi-specific (e.g., bi-specific). Multispecific antigen-binding proteins are discussed further herein.

In specific embodiments, antibody or antibody fragments of the invention may be conjugated to a moiety such a ligand or a therapeutic moiety ("immunoconjugate"), such as an anti-viral drug, a second anti-influenza antibody, or any other therapeutic moiety useful for treating a viral infection, e.g., influenza viral infection. See below.

The present invention also provides a complex comprising an anti-CoV-S antigen-binding protein, e.g., antibody or antigen-binding fragment, discussed herein complexed with CoV-S polypeptide or an antigenic fragment thereof and/or with a secondary antibody or antigen-binding fragment thereof (e.g., detectably labeled secondary antibody) that binds specifically to the anti-CoV-S antibody or fragment. In an embodiment of the invention, the antibody or fragment is in vitro (e.g., is immobilized to a solid substrate) or is in the body of a subject. In an embodiment of the invention, the CoV-S is in vitro (e.g., is immobilized to a solid substrate) or is on the surface of a virus or is in the body of a subject. Immobilized anti-CoV-S antibodies and antigen-binding fragments thereof which are covalently linked to an insoluble matrix material (e.g., glass or polysaccharide such as agarose or sepharose, e.g., a bead or other particle thereof) are also part of the present invention; optionally, wherein the immobilized antibody is complexed with CoV-S or antigenic fragment thereof or a secondary antibody or fragment thereof.

"Isolated" antigen-binding proteins, antibodies or antigen-binding fragments thereof, polypeptides, polynucleotides and vectors, are at least partially free of other biological molecules from the cells or cell culture from which they are produced. Such biological molecules include nucleic acids, proteins, other antibodies or antigen-binding fragments, lipids, carbohydrates, or other material such as cellular debris and growth medium. An isolated antibody or antigen-binding fragment may further be at least partially free of expression system components such as biological molecules from a host cell or of the growth medium thereof. Generally, the term "isolated" is not intended to refer to a complete absence of such biological molecules or to an absence of water, buffers, or salts or to components of a pharmaceutical formulation that includes the antibodies or fragments.

The term "epitope" refers to an antigenic determinant (e.g., a CoV-S polypeptide) that interacts with a specific antigen-binding site of an antigen-binding protein, e.g., a variable region of an antibody molecule, known as a paratope. A single antigen may have more than one epitope. Thus, different antibodies may bind to different areas on an antigen and may have different biological effects. The term "epitope" also refers to a site on an antigen to which B and/or T cells respond. It also refers to a region of an antigen that is bound by an antibody. Epitopes may be defined as structural or functional. Functional epitopes are generally a subset of the structural epitopes and have those residues that directly contribute to the affinity of the interaction. Epitopes may be linear or conformational, that is, composed of non-linear amino acids. In certain embodiments, epitopes may include determinants that are chemically active surface groupings of molecules such as amino acids, sugar side chains, phosphoryl groups, or sulfonyl groups, and, in certain embodiments, may have specific three-dimensional structural characteristics, and/or specific charge characteristics.

Methods for determining the epitope of an antigen-binding protein, e.g., antibody or fragment or polypeptide, include alanine scanning mutational analysis, peptide blot analysis (Reineke (2004) Methods Mol. Biol. 248: 443-63), peptide cleavage analysis, crystallographic studies and NMR analysis. In addition, methods such as epitope excision, epitope extraction and chemical modification of antigens can be employed (Tomer (2000) Prot. Sci. 9: 487-496). Another method that can be used to identify the amino acids within a polypeptide with which an antigen-binding protein (e.g., antibody or fragment or polypeptide) (e.g., coversin) interacts is hydrogen/deuterium exchange detected by mass spectrometry. In general terms, the hydrogen/deuterium exchange method involves deuterium-labeling the protein of interest, followed by binding the antigen-binding protein, e.g., antibody or fragment or polypeptide, to the deuterium-labeled protein. Next, the CoV-S protein/antigen-binding protein complex is transferred to water and exchangeable protons within amino acids that are protected by the antibody complex undergo deuterium-to-hydrogen back-exchange at a slower rate than exchangeable protons within amino acids that are not part of the interface. As a result, amino acids that form part of the protein/antigen-binding protein interface may retain deuterium and therefore exhibit relatively higher mass compared to amino acids not included in the interface. After dissociation of the antigen-binding protein (e.g., antibody or fragment or polypeptide), the target protein is subjected to protease cleavage and mass spectrometry analysis, thereby revealing the deuterium-labeled residues which correspond to the specific amino acids with which the antigen-binding protein interacts. See, e.g., Ehring (1999) Analytical Biochemistry 267: 252-259; Engen and Smith (2001) Anal. Chem. 73: 256A-265A.

The term "competes" as used herein, refers to an antigen-binding protein (e.g., antibody or antigen-binding fragment thereof) that binds to an antigen (e.g., CoV-S) and inhibits or blocks the binding of another antigen-binding protein (e.g., antibody or antigen-binding fragment thereof) to the antigen. The term also includes competition between two antigen-binding proteins e.g., antibodies, in both orientations, i.e., a first antibody that binds and blocks binding of second antibody and vice versa. In certain embodiments, the first antigen-binding protein (e.g., antibody) and second antigen-binding protein (e.g., antibody) may bind to the same epitope. Alternatively, the first and second antigen-binding proteins (e.g., antibodies) may bind to different, but, for example, overlapping epitopes, wherein binding of one inhibits or blocks the binding of the second antibody, e.g., via steric hindrance. Competition between antigen-binding proteins (e.g., antibodies) may be measured by methods known in the art, for example, by a real-time, label-free bio-layer interferometry assay. Epitope mapping (e.g., via alanine scanning or hydrogen-deuterium exchange (HDX)) can be used to determine whether two or more antibodies are non-competing (e.g., on a spike protein receptor binding domain (RBD) monomer), competing for the same epitope, or competing but with diverse micro-epitopes (e.g., identified through HDX). In an embodiment of the invention, competition between a first and second anti-CoV-S antigen-binding protein (e.g., antibody) is determined by measuring the ability of an immobilized first anti-CoV-S antigen-binding protein (e.g., antibody) (not initially complexed with CoV-S protein) to bind to soluble CoV-S protein complexed with a second anti-CoV-S antigen-binding protein (e.g., antibody). A reduction in the ability of the first anti-CoV-S antigen-binding protein (e.g., antibody) to bind to the complexed CoV-S protein, relative to uncomplexed CoV-S protein, indicates that the first and second anti-CoV-S antigen-binding proteins (e.g., antibodies) compete. The degree of competition can be expressed as a percentage of the reduction in binding. Such competition can be measured using a real time, label-free bio-layer interferometry assay, e.g., on an Octet RED384 biosensor (Pall ForteBio Corp.), ELISA (enzyme-linked immunosorbent assays) or SPR (surface plasmon resonance).

Binding competition between anti-CoV-S antigen-binding proteins (e.g., monoclonal antibodies (mAbs)) can be determined using a real time, label-free bio-layer interferometry assay on an Octet RED384 biosensor (Pall ForteBio Corp.). For example, to determine competition between two anti-CoV-S monoclonal antibodies, the anti-CoV-S mAb can be first captured onto anti-hFc antibody coated Octet biosensor tips (Pall ForteBio Corp., #18-5060) by submerging the tips into a solution of anti-CoV-S mAb (subsequently referred to as "mAb1"). As a positive-control for blocking, the antibody captured biosensor tips can then be saturated with a known blocking isotype control mAb (subsequently referred to as "blocking mAb") by dipping into a solution of blocking mAb. To determine if mAb2 competes with mAb1, the biosensor tips can then be subsequently dipped into a co-complexed solution of CoV-S polypeptide and a second anti-CoV-S mAb (subsequently referred to as "mAb2"), that had been pre-incubated for a period of time and binding of mAb1 to the CoV-S polypeptide can be determined. The biosensor tips can be washed in buffer in between every step of the experiment. The real-time binding response can be monitored during the course of the experiment and the binding response at the end of every step can be recorded.

For example, in an embodiment of the invention, the competition assay is conducted at 25° C. and pH about 7, e.g., 7.4, e.g., in the presence of buffer, salt, surfactant and a non-specific protein (e.g., bovine serum albumin).

Typically, an antibody or antigen-binding fragment of the invention which is modified in some way retains the ability to specifically bind to CoV-S, e.g., retains at least 10% of its CoV-S binding activity (when compared to the parental antibody) when that activity is expressed on a molar basis. Preferably, an antibody or antigen-binding fragment of the invention retains at least 20%, 50%, 70%, 80%, 90%, 95% or 100% or more of the CoV-S binding affinity as the parental antibody. It is also intended that an antibody or antigen-binding fragment of the invention can include conservative or non-conservative amino acid substitutions (referred to as "conservative variants" or "function conserved variants" of the antibody) that do not substantially alter its biologic activity.

A "variant" of a polypeptide, such as an immunoglobulin chain (e.g., mAb8021 $V_H$, $V_L$, HC, or LC, mAb8028 $V_H$, $V_L$, HC, or LC, or mAb8029 $V_H$, $V_L$, HC, or LC), refers to a polypeptide comprising an amino acid sequence that is at least about 70-99.9% (e.g., 70, 72, 74, 76, 79, 80, 81, 82, 83, 84, 85, 86, 87, 88, 89, 90, 91, 92, 93, 94, 95, 96, 97, 98, 99, 99.5, 99.9%) identical or similar to a referenced amino acid sequence that is set forth herein (e.g., SEQ ID NO: 2, 10, 18, 20, 22, 30, 38, 40, 42, 50, 58, or 60); when the comparison is performed by a BLAST algorithm wherein the parameters of the algorithm are selected to give the largest match between the respective sequences over the entire length of the respective reference sequences (e.g., expect threshold: 10; word size: 3; max matches in a query range: 0; BLOSUM 62 matrix; gap costs: existence 11, extension 1; conditional compositional score matrix adjustment).

A "variant" of a polynucleotide refers to a polynucleotide comprising a nucleotide sequence that is at least about 70-99.9% (e.g., at least about 70, 72, 74, 75, 76, 79, 80, 81, 82, 83, 84, 85, 86, 87, 88, 89, 90, 91, 92, 93, 94, 95, 96, 97, 98, 99, 99.5, or 99.9%) identical to a referenced nucleotide sequence that is set forth herein (e.g., SEQ ID NO: 1, 9, 17, 19, 21, 29, 37, 39, 41, 49, 57, or 59); when the comparison is performed by a BLAST algorithm wherein the parameters of the algorithm are selected to give the largest match between the respective sequences over the entire length of the respective reference sequences (e.g., expect threshold: 10; word size: 28; max matches in a query range: 0; match/mismatch scores: 1, −2; gap costs: linear).

Anti-CoV-S antigen-binding proteins, e.g., antibodies and antigen-binding fragments thereof of the present invention, in an embodiment of the invention, include a heavy chain immunoglobulin variable region having at least 70% (e.g., 80%, 85%, 90%, 91%, 92%, 93%, 94%, 95%, 96%, 97%, 98%, 99%, or greater) amino acid sequence identity to the HCVR amino acid sequences set forth in Table 1; and/or a light chain immunoglobulin variable region having at least 70% (e.g., 80%, 85%, 90%, 91%, 92%, 93%, 94%, 95%, 96%, 97%, 98%, 99%, or greater) amino acid sequence identity to the LCVR amino acid sequences set forth in Table 1.

In addition, a variant anti-CoV-S antigen-binding protein may include a polypeptide comprising an amino acid sequence that is set forth herein except for one or more (e.g., 1, 2, 3, 4, 6, 7, 8, 9 or 10) mutations such as, for example, missense mutations (e.g., conservative substitutions), nonsense mutations, deletions, or insertions. For example, the present invention includes antigen-binding proteins which include an immunoglobulin light chain variant comprising an LCVR amino acid sequence set forth in Table 1 but having one or more of such mutations and/or an immunoglobulin heavy chain variant comprising an HCVR amino acid sequence set forth in Table 1 but having one or more of such mutations. In an embodiment of the invention, a variant anti-CoV-S antigen-binding protein includes an immunoglobulin light chain variant comprising CDR-L1, CDR-L2 and CDR-L3 wherein one or more (e.g., 1 or 2 or 3) of such CDRs has one or more of such mutations (e.g., conservative substitutions) and/or an immunoglobulin heavy chain variant comprising CDR-H1, CDR-H2 and CDR-H3 wherein one or more (e.g., 1 or 2 or 3) of such CDRs has one or more of such mutations (e.g., conservative substitutions). Substitutions can be in a CDR, framework, or constant region.

The invention further provides variant anti-CoV-S antigen-binding proteins, e.g., antibodies or antigen-binding fragments thereof, comprising one or more variant CDRs (e.g., any one or more of CDR-L1, CDR-L2, CDR-L3, CDR-H1, CDR-H2 and/or CDR-H3) that are set forth herein with at least 70%, 75%, 80%, 85%, 90%, 91%, 92%, 93%, 94%, 95%, 96%, 97%, 98%, 99%, or 99.9% sequence identity or similarity to, e.g., the heavy chain and light chain CDRs of Table 1.

Embodiments of the present invention also include variant antigen-binding proteins, e.g., anti-CoV-S antibodies and antigen-binding fragments thereof, that comprise immunoglobulin $V_H$s and $V_L$s; or HCs and LCs, which comprise an amino acid sequence having 70% or more (e.g., 80%, 85%, 90%, 91%, 92%, 93%, 94%, 95%, 96%, 97%, 98%, 99%, or greater) overall amino acid sequence identity or similarity to the amino acid sequences of the corresponding $V_H$s, $V_L$s, HCs or LCs specifically set forth herein, but wherein the CDR-L1, CDR-L2, CDR-L3, CDR-H1, CDR-H2 and CDR-H3 of such immunoglobulins are not variants and comprise CDR amino acid sequence set forth in Table 1. Thus, in such embodiments, the CDRs within variant antigen-binding proteins are not, themselves, variants.

Conservatively modified variant anti-CoV-S antibodies and antigen-binding fragments thereof are also part of the present invention. A "conservatively modified variant" or a "conservative substitution" refers to a variant wherein there is one or more substitutions of amino acids in a polypeptide with other amino acids having similar characteristics (e.g. charge, side-chain size, hydrophobicity/hydrophilicity, backbone conformation and rigidity, etc.). Such changes can frequently be made without significantly disrupting the biological activity of the antibody or fragment. Those of skill in this art recognize that, in general, single amino acid substitutions in non-essential regions of a polypeptide do not substantially alter biological activity (see, e.g., Watson et al. (1987) Molecular Biology of the Gene, The Benjamin/Cummings Pub. Co., p. 224 ($4^{th}$ Ed.)). In addition, substitutions of structurally or functionally similar amino acids are less likely to significantly disrupt biological activity.

Examples of groups of amino acids that have side chains with similar chemical properties include 1) aliphatic side chains: glycine, alanine, valine, leucine and isoleucine; 2) aliphatic-hydroxyl side chains: serine and threonine; 3) amide-containing side chains: asparagine and glutamine; 4) aromatic side chains: phenylalanine, tyrosine, and tryptophan; 5) basic side chains: lysine, arginine, and histidine; 6) acidic side chains: aspartate and glutamate, and 7) sulfur-containing side chains: cysteine and methionine. Preferred conservative amino acids substitution groups are: valine-leucine-isoleucine, phenylalanine-tyrosine, lysine-arginine, alanine-valine, glutamate-aspartate, and asparagine-glutamine. Alternatively, a conservative replacement is any change having a positive value in the PAM250 log-likelihood matrix disclosed in Gonnet et al. (1992) Science 256: 1443 45.

Function-conservative variants of the anti-CoV-S antibodies and antigen-binding fragments thereof are also part of the present invention. Any of the variants of the anti-CoV-S antibodies and antigen-binding fragments thereof (as discussed herein) may be "function-conservative variants". Such function-conservative variants may, in some cases, also be characterized as conservatively modified variants. "Function-conservative variants," as used herein, refers to variants of the anti-CoV-S antibodies or antigen-binding fragments thereof in which one or more amino acid residues have been changed without significantly altering one or more functional properties of the antibody or fragment. In an embodiment of the invention, a function-conservative variant anti-CoV-S antibody or antigen-binding fragment thereof of the present invention comprises a variant amino acid sequence and exhibits one or more of the following functional properties:

Inhibits growth of coronavirus (e.g., SARS-CoV-2, SARS-CoV, and/or MERS-CoV) in ACE2- and/or TMPRSS2-expressing cells (e.g., Calu-3 cells);

Does not significantly bind to MDCK/Tet-on cells which do not express ACE2 and/or TMPRSS2;

Limits spread of coronavirus infection (e.g., by SARS-CoV-2, SARS-CoV, and/or MERS-CoV) of cells, e.g., Calu-3, in vitro; and/or Protects a mouse engineered to express the human TMPRSS2 and/or ACE2 protein from death caused by coronavirus infection (e.g., SARS-CoV-2, SARS-CoV, or MERS-CoV), for example, wherein the mice are infected with an otherwise lethal dose of the virus, optionally when combined with a second therapeutic agent.

Protects a mouse engineered to express the human TMPRSS2 and/or ACE2 protein from weight loss caused by coronavirus infection (e.g., SARS-CoV-2, SARS-CoV, or MERS-CoV), for example, wherein the mice are infected with a dose of the virus that would otherwise cause weight loss, optionally when combined with a second therapeutic agent.

A "neutralizing" or "antagonist" anti-CoV-S antigen-binding protein, e.g., antibody or antigen-binding fragment, refers to a molecule that inhibits an activity of CoV-S to any detectable degree, e.g., inhibits the ability of CoV-S to bind to a receptor such as ACE2, to be cleaved by a protease such as TMPRSS2, or to mediate viral entry into a host cell or viral reproduction in a host cell.

Table 1 refers to antigen-binding proteins, such as antibodies and antigen-binding fragments thereof, that comprise the heavy chain or $V_H$ (or a variant thereof) and light chain or $V_L$ (or a variant thereof) as set forth below; or that comprise a $V_H$ that comprises the CDRs thereof (CDR-H1 (or a variant thereof), CDR-H2 (or a variant thereof) and CDR-H3 (or a variant thereof)) and a $V_L$ that comprises the CDRs thereof (CDR-L1 (or a variant thereof), CDR-L2 (or a variant thereof) and CDR-L3 (or a variant thereof)), e.g., wherein the immunoglobulin chains, variable regions and/or CDRs comprise the specific amino acid sequences described below.

The antibodies described herein also include embodiments wherein the $V_H$ is fused to a wild-type IgG4 (e.g., wherein residue 108 is S) or to IgG4 variants (e.g., wherein residue 108 is P).

Antibodies and antigen-binding fragments of the present invention comprise immunoglobulin chains including the amino acid sequences set forth herein as well as cellular and in vitro post-translational modifications to the antibody. For example, the present invention includes antibodies and antigen-binding fragments thereof that specifically bind to CoV-S comprising heavy and/or light chain amino acid sequences set forth herein (e.g., CDR-H1, CDR-H2, CDR-H3, CDR-L1, CDR-L2 and/or CDR-L3) as well as antibodies and fragments wherein one or more amino acid residues is glycosylated, one or more Asn residues is deamidated, one or more residues (e.g., Met, Trp and/or His) is oxidized, the N-terminal Gln is pyroglutamate (pyroE) and/or the C-terminal Lysine is missing.

The amino acid and nucleotide sequences of exemplary anti-SARS-CoV-2-Spike protein (SARS-CoV-2-S) antibodies are shown below:

| Antibody Designation | Component Part | Sequence | SEQ ID NO |
|---|---|---|---|
| mAb10933 | | Amino Acids | |
| | HCVR | QVQLVESGGGLVKPGGSLRLSCAASGFTFSDYYM SWIRQAPGKGLEWVSYITYSGSTIYYADSVKGRF TISRDNAKSSLYLQMNSLRAEDTAVYYCARDRGT TMVPFDYWGQGTLVTVSS | 202 |
| | HCDR1 | GFTFSDYY | 204 |
| | HCDR2 | ITYSGSTI | 206 |
| | HCDR3 | ARDRGTTMVPFDY | 208 |
| | LCVR | DIQMTQSPSSLSASVGDRVTITCQASQDITNYLN WYQQKPGKAPKLLIYAASNLETGVPSRFSGSGSG TDFTFTISGLQPEDIATYYCQQYDNLPLTFGGGT KVEIK | 210 |
| | LCDR1 | QDITNY | 212 |
| | LCDR2 | AAS | 55 |
| | LCDR3 | QQYDNLPLT | 214 |
| | HC | QVQLVESGGGLVKPGGSLRLSCAASGFTFSDYYM SWIRQAPGKGLEWVSYITYSGSTIYYADSVKGRF TISRDNAKSSLYLQMNSLRAEDTAVYYCARDRGT TMVPFDYWGQGTLVTVSSASTKGPSVFPLAPSSK STSGGTAALGCLVKDYFPEPVTVSWNSGALTSGV HTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALPAPIEKTIS KAKGQPREPQVYTLPPSRDELTKNQVSLTCLVKG FYPSDIAVEWESNGQPENNYKTTPPVLDSDGSFF LYSKLTVDKSRWQQGNVFSCSVMHEALHNHYTQK SLSLSPGK | 216 |
| | LC | DIQMTQSPSSLSASVGDRVTITCQASQDITNYLN WYQQKPGKAPKLLIYAASNLETGVPSRFSGSGSG TDFTFTISGLQPEDIATYYCQQYDNLPLTFGGGT KVEIKRTVAAPSVFIFPPSDEQLKSGTASVVCLL NNFYPREAKVQWKVDNALQSGNSQESVTEQDSKD STYSLSSTLTLSKADYEKHKVYACEVTHQGLSSP VTKSFNRGEC | 218 |
| | | Nucleic Acids | |
| | HCVR | CAGGTGCAGCTGGTGGAGTCTGGGGGAGGCTTGG TCAAGCCTGGAGGGTCCCTGAGACTCTCCTGTGC AGCCTCTGGATTCACCTTCAGTGACTACTACATG AGCTGGATCCGCCAGGCTCCAGGGAAGGGGCTGG AGTGGGTTTCATACATTACTTATAGTGGTAGTAC CATATACTACGCAGACTCTGTGAAGGGCCGATTC ACCATCTCCAGGGACAACGCCAAGAGCTCACTGT ATCTGCAAATGAACAGCCTGAGAGCCGAGGACAC GGCCGTGTATTACTGTGCGAGAGATCGCGGTACA ACTATGGTCCCCTTTGACTACTGGGGCCAGGGAA CCCTGGTCACCGTCTCCTCA | 201 |
| | HCDR1 | GGATTCACCTTCAGTGACTACTAC | 203 |
| | HCDR2 | ATTACTTATAGTGGTAGTACCATA | 205 |
| | HCDR3 | GCGAGAGATCGCGGTACAACTATGGTCCCCTTTG ACTAC | 207 |
| | LCVR | GACATCCAGATGACCCAGTCTCCATCCTCCCTGT CTGCATCTGTAGGAGACAGAGTCACCATCACTTG CCAGGCGAGTCAGGACATTACCAACTATTTAAAT TGGTATCAGCAGAAACCAGGGAAAGCCCCTAAGC TCCTGATCTACGCTGCATCCAATTTGGAAACAGG GGTCCCATCAAGGTTCAGTGGAAGTGGATCTGGG ACAGATTTTACTTTCACCATCAGCGGCCTGCAGC CTGAAGATATTGCAACATATTACTGTCAACAGTA TGATAATCTCCCTCTCACTTTCGGCGGAGGGACC AAGGTGGAGATCAAA | 209 |

-continued

| Antibody Designation | Component Part | Sequence | SEQ ID NO |
|---|---|---|---|
| | LCDR1 | CAGGACATTACCAACTAT | 211 |
| | LCDR2 | GCTGCATCC | 54 |
| | LCDR3 | CAACAGTATGATAATCTCCCTCTCACT | 213 |
| | HC | CAGGTGCAGCTGGTGGAGTCTGGGGGAGGCTTGG TCAAGCCTGGAGGGTCCCTGAGACTCTCCTGTGC AGCCTCTGGATTCACCTTCAGTGACTACTACATG AGCTGGATCCGCCAGGCTCCAGGGAAGGGGCTGG AGTGGGTTTCATACATTACTTATAGTGGTAGTAC CATATACTACGCAGACTCTGTGAAGGGCCGATTC ACCATCTCCAGGGACAACGCCAAGAGCTCACTGT ATCTGCAAATGAACAGCCTGAGAGCCGAGGACAC GGCCGTGTATTACTGTGCGAGAGATCGCGGTACA ACTATGGTCCCCTTTGACTACTGGGGCCAGGGAA CCCTGGTCACCGTCTCCTCAGCCTCCACCAAGGG CCCATCGGTCTTCCCCCTGGCACCCTCCTCCAAG AGCACCTCTGGGGGCACAGCGGCCCTGGGCTGCC TGGTCAAGGACTACTTCCCCGAACCGGTGACGGT GTCGTGGAACTCAGGCGCCCTGACCAGCGGCGTG CACACCTTCCCGGCTGTCCTACAGTCCTCAGGAC TCTACTCCCTCAGCAGCGTGGTGACCGTGCCCTC CAGCAGCTTGGGCACCCAGACCTACATCTGCAAC GTGAATCACAAGCCCAGCAACACCAAGGTGGACA AGAAAGTTGAGCCCAAATCTTGTGACAAAACTCA CACATGCCCACCGTGCCCAGCACCTGAACTCCTG GGGGGACCGTCAGTCTTCCTCTTCCCCCCAAAAC CCAAGGACACCCTCATGATCTCCCGGACCCCTGA GGTCACATGCGTGGTGGTGGACGTGAGCCACGAA GACCCTGAGGTCAAGTTCAACTGGTACGTGGACG GCGTGGAGGTGCATAATGCCAAGACAAAGCCGCG GGAGGAGCAGTACAACAGCACGTACCGTGTGGTC AGCGTCCTCACCGTCCTGCACCAGGACTGGCTGA ATGGCAAGGAGTACAAGTGCAAGGTCTCCAACAA AGCCCTCCCAGCCCCCATCGAGAAAACCATCTCC AAAGCCAAAGGGCAGCCCCGAGAACCACAGGTGT ACACCCTGCCCCCATCCCGGGATGAGCTGACCAA GAACCAGGTCAGCCTGACCTGCCTGGTCAAAGGC TTCTATCCCAGCGACATCGCCGTGGAGTGGGAGA GCAATGGGCAGCCGGAGAACAACTACAAGACCAC GCCTCCCGTGCTGGACTCCGACGGCTCCTTCTTC CTCTACAGCAAGCTCACCGTGGACAAGAGCAGGT GGCAGCAGGGGAACGTCTTCTCATGCTCCGTGAT GCATGAGGCTCTGCACAACCACTACACGCAGAAG TCCCTCTCCCTGTCTCCGGGTAAATGA | 215 |
| | LC | GACATCCAGATGACCCAGTCTCCATCCTCCCTGT CTGCATCTGTAGGAGACAGAGTCACCATCACTTG CCAGGCGAGTCAGGACATTACCAACTATTTAAAT TGGTATCAGCAGAAACCAGGGAAAGCCCCTAAGC TCCTGATCTACGCTGCATCCAATTTGGAAACAGG GGTCCCATCAAGGTTCAGTGGAAGTGGATCTGGG ACAGATTTTACTTTCACCATCAGCGGCCTGCAGC CTGAAGATATTGCAACATATTACTGTCAACAGTA TGATAATCTCCCTCTCACTTTCGGCGGAGGGACC AAGGTGGAGATCAAACGAACTGTGGCTGCACCAT CTGTCTTCATCTTCCCGCCATCTGATGAGCAGTT GAAATCTGGAACTGCCTCTGTTGTGTGCCTGCTG AATAACTTCTATCCCAGAGAGGCCAAAGTACAGT GGAAGGTGGATAACGCCCTCCAATCGGGTAACTC CCAGGAGAGTGTCACAGAGCAGGACAGCAAGGAC AGCACCTACAGCCTCAGCAGCACCCTGACGCTGA GCAAAGCAGACTACGAGAAACACAAAGTCTACGC CTGCGAAGTCACCCATCAGGGCCTGAGCTCGCCC GTCACAAAGAGCTTCAACAGGGGAGAGTGTTAG | 217 |
| mAb10934 | | Amino Acids | |
| | HCVR | EVQLVESGGGLVKPGGSLRLSCAASGITFSNAWM SWVRQAPGKGLEWVGRIKSKTDGGTTDYAAPVKG RFTISRDDSKNTLYLQMNSLKTEDTAVYYCTTAR WDWYFDLWGRGTLVTVSS | 220 |
| | HCDR1 | GITFSNAW | 222 |

-continued

| Antibody Designation | Component Part | Sequence | SEQ ID NO |
|---|---|---|---|
| | HCDR2 | IKSKTDGGTT | 224 |
| | HCDR3 | TTARWDWYFDL | 226 |
| | LCVR | DIQMTQSPSSLSASVGDRVTITCQASQDIWNYIN WYQQKPGKAPKLLIYDASNLKTGVPSRFSGSGSG TDFTFTISSLQPEDIATYYCQQHDDLPPTFGQGT KVEIK | 228 |
| | LCDR1 | QDIWNY | 230 |
| | LCDR2 | DAS | 194 |
| | LCDR3 | QQHDDLPPT | 232 |
| | HC | EVQLVESGGGLVKPGGSLRLSCAASGITFSNAWM SWVRQAPGKGLEWVGRIKSKTDGGTTDYAAPVKG RFTISRDDSKNTLYLQMNSLKTEDTAVYYCTTAR WDWYFDLWGRGTLVTVSSASTKGPSVFPLAPSSK STSGGTAALGCLVKDYFPEPVTVSWNSGALTSGV HTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALPAPIEKTIS KAKGQPREPQVYTLPPSRDELTKNQVSLTCLVKG FYPSDIAVEWESNGQPENNYKTTPPVLDSDGSFF LYSKLTVDKSRWQQGNVFSCSVMHEALHNHYTQK SLSLSPGK | 234 |
| | LC | DIQMTQSPSSLSASVGDRVTITCQASQDIWNYIN WYQQKPGKAPKLLIYDASNLKTGVPSRFSGSGSG TDFTFTISSLQPEDIATYYCQQHDDLPPTFGQGT KVEIKRTVAAPSVFIFPPSDEQLKSGTASVVCLL NNFYPREAKVQWKVDNALQSGNSQESVTEQDSKD STYSLSSTLTLSKADYEKHKVYACEVTHQGLSSP VTKSFNRGEC | 236 |
| | | Nucleic Acids | |
| | HCVR | GAGGTGCAGCTGGTGGAGTCTGGGGGAGGCTTGG TAAAGCCTGGGGGGTCCCTTAGACTCTCCTGTGC AGCCTCTGGAATCACTTTCAGTAACGCCTGGATG AGTTGGGTCCGCCAGGCTCCAGGGAAGGGGCTGG AGTGGGTTGGCCGTATTAAAAGCAAAACTGATGG TGGGACAACAGACTACGCCGCACCCGTGAAAGGC AGATTCACCATCTCAAGAGATGATTCAAAAAACA CGCTGTATCTACAAATGAACAGCCTGAAAACCGA GGACACAGCCGTGTATTACTGTACCACAGCGAGG TGGGACTGGTACTTCGATCTCTGGGGCCGTGGCA CCCTGGTCACTGTCTCCTCA | 219 |
| | HCDR1 | GGAATCACTTTCAGTAACGCCTGG | 221 |
| | HCDR2 | ATTAAAAGCAAAACTGATGGTGGGACAACA | 223 |
| | HCDR3 | ACCACAGCGAGGTGGGACTGGTACTTCGATCTC | 225 |
| | LCVR | GACATCCAGATGACCCAGTCTCCATCCTCCCTGT CTGCATCTGTAGGAGACAGAGTCACCATCACTTG CCAGGCGAGTCAGGACATTTGGAATTATATAAAT TGGTATCAGCAGAAACCAGGGAAGGCCCCTAAGC TCCTGATCTACGATGCATCCAATTTGAAAACAGG GGTCCCATCAAGGTTCAGTGGAAGTGGATCTGGG ACAGATTTTACTTTCACCATCAGCAGCCTGCAGC CTGAAGATATTGCAACATATTACTGTCAACAGCA TGATGATCTCCCTCCGACCTTCGGCCAAGGGACC AAGGTGGAAATCAAA | 227 |
| | LCDR1 | CAGGACATTTGGAATTAT | 229 |
| | LCDR2 | GATGCATCC | 193 |
| | LCDR3 | CAACAGCATGATGATCTCCCTCCGACC | 231 |

-continued

| Antibody Designation | Component Part | Sequence | SEQ ID NO |
|---|---|---|---|
| | HC | GAGGTGCAGCTGGTGGAGTCTGGGGGAGGCTTGG TAAAGCCTGGGGGGTCCCTTAGACTCTCCTGTGC AGCCTCTGGAATCACTTTCAGTAACGCCTGGATG AGTTGGGTCCGCCAGGCTCCAGGGAAGGGGCTGG AGTGGGTTGGCCGTATTAAAAGCAAAACTGATGG TGGGACAACAGACTACGCCGCACCCGTGAAAGGC AGATTCACCATCTCAAGAGATGATTCAAAAAACA CGCTGTATCTACAAATGAACAGCCTGAAAACCGA GGACACAGCCGTGTATTACTGTACCACAGCGAGG TGGGACTGGTACTTCGATCTCTGGGGCCGTGGCA CCCTGGTCACTGTCTCCTCAGCCTCCACCAAGGG CCCATCGGTCTTCCCCCTGGCACCCTCCTCCAAG AGCACCTCTGGGGGCACAGCGGCCCTGGGCTGCC TGGTCAAGGACTACTTCCCCGAACCGGTGACGGT GTCGTGGAACTCAGGCGCCCTGACCAGCGGCGTG CACACCTTCCCGGCTGTCCTACAGTCCTCAGGAC TCTACTCCCTCAGCAGCGTGGTGACCGTGCCCTC CAGCAGCTTGGGCACCCAGACCTACATCTGCAAC GTGAATCACAAGCCCAGCAACACCAAGGTGGACA AGAAAGTTGAGCCCAAATCTTGTGACAAAACTCA CACATGCCCACCGTGCCCAGCACCTGAACTCCTG GGGGGACCGTCAGTCTTCCTCTTCCCCCCAAAAC CCAAGGACACCCTCATGATCTCCCGGACCCCTGA GGTCACATGCGTGGTGGTGGACGTGAGCCACGAA GACCCTGAGGTCAAGTTCAACTGGTACGTGGACG GCGTGGAGGTGCATAATGCCAAGACAAAGCCGCG GGAGGAGCAGTACAACAGCACGTACCGTGTGGTC AGCGTCCTCACCGTCCTGCACCAGGACTGGCTGA ATGGCAAGGAGTACAAGTGCAAGGTCTCCAACAA AGCCCTCCCAGCCCCCATCGAGAAAACCATCTCC AAAGCCAAAGGGCAGCCCCGAGAACCACAGGTGT ACACCCTGCCCCCATCCCGGGATGAGCTGACCAA GAACCAGGTCAGCCTGACCTGCCTGGTCAAAGGC TTCTATCCCAGCGACATCGCCGTGGAGTGGGAGA GCAATGGGCAGCCGGAGAACAACTACAAGACCAC GCCTCCCGTGCTGGACTCCGACGGCTCCTTCTTC CTCTACAGCAAGCTCACCGTGGACAAGAGCAGGT GGCAGCAGGGGAACGTCTTCTCATGCTCCGTGAT GCATGAGGCTCTGCACAACCACTACACGCAGAAG TCCCTCTCCCTGTCTCCGGGTAAATGA | 233 |
| | LC | GACATCCAGATGACCCAGTCTCCATCCTCCCTGT CTGCATCTGTAGGAGACAGAGTCACCATCACTTG CCAGGCGAGTCAGGACATTTGGAATTATATAAAT TGGTATCAGCAGAAACCAGGGAAGGCCCCTAAGC TCCTGATCTACGATGCATCCAATTTGAAAACAGG GGTCCCATCAAGGTTCAGTGGAAGTGGATCTGGG ACAGATTTTACTTTCACCATCAGCAGCCTGCAGC CTGAAGATATTGCAACATATTACTGTCAACAGCA TGATGATCTCCCTCCGACCTTCGGCCAAGGGACC AAGGTGGAAATCAAACGAACTGTGGCTGCACCAT CTGTCTTCATCTTCCCGCCATCTGATGAGCAGTT GAAATCTGGAACTGCCTCTGTTGTGTGCCTGCTG AATAACTTCTATCCCAGAGAGGCCAAAGTACAGT GGAAGGTGGATAACGCCCTCCAATCGGGTAACTC CCAGGAGAGTGTCACAGAGCAGGACAGCAAGGAC AGCACCTACAGCCTCAGCAGCACCCTGACGCTGA GCAAAGCAGACTACGAGAAACACAAAGTCTACGC CTGCGAAGTCACCCATCAGGGCCTGAGCTCGCCC GTCACAAAGAGCTTCAACAGGGGAGAGTGTTAG | 235 |
| mAb10987 | | Amino Acids | |
| | HCVR | QVQLVESGGGVVQPGRSLRLSCAASGFTFSNYAM YWVRQAPGKGLEWVAVISYDGSNKYYADSVKGRF TISRDNSKNTLYLQMNSLRTEDTAVYYCASGSDY GDYLLVYWGQGTLVTVSS | 640 |
| | HCDR1 | GFTFSNYA | 642 |
| | HCDR2 | ISYDGSNK | 499 |
| | HCDR3 | ASGSDYGDYLLVY | 644 |

-continued

| Antibody Designation | Component Part | Sequence | SEQ ID NO |
|---|---|---|---|
| | LCVR | QSALTQPASVSGSPGQSITISCTGTSSDVGGYNY VSWYQQHPGKAPKLMIYDVSKRPSGVSNRFSGSK SGNTASLTISGLQSEDEADYYCNSLTSISTWVFG GGTKLTVL | 646 |
| | LCDR1 | SSDVGGYNY | 648 |
| | LCDR2 | DVS | 650 |
| | LCDR3 | NSLTSISTWV | 652 |
| | HC | QVQLVESGGGVVQPGRSLRLSCAASGFTFSNYAM YWVRQAPGKGLEWVAVISYDGSNKYYADSVKGRF TISRDNSKNTLYLQMNSLRTEDTAVYYCASGSDY GDYLLVYWGQGTLVTVSSASTKGPSVFPLAPSSK STSGGTAALGCLVKDYFPEPVTVSWNSGALTSGV HTFPAVLQSSGLYSLSSVVTVPSSSLGTQTYICN VNHKPSNTKVDKKVEPKSCDKTHTCPPCPAPELL GGPSVFLFPPKPKDTLMISRTPEVTCVVVDVSHE DPEVKFNWYVDGVEVHNAKTKPREEQYNSTYRVV SVLTVLHQDWLNGKEYKCKVSNKALPAPIEKTIS KAKGQPREPQVYTLPPSRDELTKNQVSLTCLVKG FYPSDIAVEWESNGQPENNYKTTPPVLDSDGSFF LYSKLTVDKSRWQQGNVFSCSVMHEALHNHYTQK SLSLSPGK | 654 |
| | LC | QSALTQPASVSGSPGQSITISCTGTSSDVGGYNY VSWYQQHPGKAPKLMIYDVSKRPSGVSNRFSGSK SGNTASLTISGLQSEDEADYYCNSLTSISTWVFG GGTKLTVLGQPKAAPSVTLFPPSSEELQANKATL VCLISDFYPGAVTVAWKADSSPVKAGVETTTPSK QSNNKYAASSYLSLTPEQWKSHRSYSCQVTHEGS TVEKTVAPTECS | 656 |
| | | Nucleic Acids | |
| | HCVR | CAGGTGCAGCTGGTGGAGTCTGGGGGAGGCGTGG TCCAGCCTGGGAGGTCCCTGAGACTCTCCTGTGC AGCCTCTGGATTCACCTTCAGTAACTATGCTATG TACTGGGTCCGCCAGGCTCCAGGCAAGGGGCTGG AGTGGGTGGCAGTTATATCATATGATGGAAGTAA TAAATACTATGCAGACTCCGTGAAGGGCCGATTC ACCATCTCCAGAGACAATTCCAAGAACACGCTGT ATCTGCAAATGAACAGCCTGAGAACTGAGGACAC GGCTGTGTATTACTGTGCGAGTGGCTCCGACTAC GGTGACTACTTATTGGTTTACTGGGGCCAGGGAA CCCTGGTCACCGTCTCCTCA | 639 |
| | HCDR1 | GGATTCACCTTCAGTAACTATGCT | 641 |
| | HCDR2 | ATATCATATGATGGAAGTAATAAA | 498 |
| | HCDR3 | GCGAGTGGCTCCGACTACGGTGACTACTTATTGG TTTAC | 643 |
| | LCVR | CAGTCTGCCCTGACTCAGCCTGCCTCCGTGTCTG GGTCTCCTGGACAGTCGATCACCATCTCCTGCAC TGGAACCAGCAGTGACGTTGGTGGTTATAACTAT GTCTCCTGGTACCAACAACACCCAGGCAAAGCCC CCAAACTCATGATTTATGATGTCAGTAAGCGGCC CTCAGGGGTTTCTAATCGCTTCTCTGGCTCCAAG TCTGGCAACACGGCCTCCCTGACCATCTCTGGGC TCCAGTCTGAGGACGAGGCTGATTATTACTGCAA CTCTTTGACAAGCATCAGCACTTGGGTGTTCGGC GGAGGGACCAAGCTGACCGTCCTA | 645 |
| | LCDR1 | AGCAGTGACGTTGGTGGTTATAACTAT | 647 |
| | LCDR2 | GATGTCAGT | 649 |
| | LCDR3 | AACTCTTTGACAAGCATCAGCACTTGGGTG | 651 |
| | HC | CAGGTGCAGCTGGTGGAGTCTGGGGGAGGCGTGG TCCAGCCTGGGAGGTCCCTGAGACTCTCCTGTGC AGCCTCTGGATTCACCTTCAGTAACTATGCTATG TACTGGGTCCGCCAGGCTCCAGGCAAGGGGCTGG | 653 |

-continued

| Antibody Designation | Component Part | Sequence | SEQ ID NO |
|---|---|---|---|
| | | AGTGGGTGGCAGTTATATCATATGATGGAAGTAA TAAATACTATGCAGACTCCGTGAAGGGCCGATTC ACCATCTCCAGAGACAATTCCAAGAACACGCTGT ATCTGCAAATGAACAGCCTGAGAACTGAGGACAC GGCTGTGTATTACTGTGCGAGTGGCTCCGACTAC GGTGACTACTTATTGGTTTACTGGGGCCAGGGAA CCCTGGTCACCGTCTCCTCAGCCTCCACCAAGGG CCCATCGGTCTTCCCCCTGGCACCCTCCTCCAAG AGCACCTCTGGGGGCACAGCGGCCCTGGGCTGCC TGGTCAAGGACTACTTCCCCGAACCGGTGACGGT GTCGTGGAACTCAGGCGCCCTGACCAGCGGCGTG CACACCTTCCCGGCTGTCCTACAGTCCTCAGGAC TCTACTCCCTCAGCAGCGTGGTGACCGTGCCCTC CAGCAGCTTGGGCACCCAGACCTACATCTGCAAC GTGAATCACAAGCCCAGCAACACCAAGGTGGACA AGAAAGTTGAGCCCAAATCTTGTGACAAAACTCA CACATGCCCACCGTGCCCAGCACCTGAACTCCTG GGGGGACCGTCAGTCTTCCTCTTCCCCCCAAAAC CCAAGGACACCCTCATGATCTCCCGGACCCCTGA GGTCACATGCGTGGTGGTGGACGTGAGCCACGAA GACCCTGAGGTCAAGTTCAACTGGTACGTGGACG GCGTGGAGGTGCATAATGCCAAGACAAAGCCGCG GGAGGAGCAGTACAACAGCACGTACCGTGTGGTC AGCGTCCTCACCGTCCTGCACCAGGACTGGCTGA ATGGCAAGGAGTACAAGTGCAAGGTCTCCAACAA AGCCCTCCCAGCCCCCATCGAGAAAACCATCTCC AAAGCCAAAGGGCAGCCCCGAGAACCACAGGTGT ACACCCTGCCCCCATCCCGGGATGAGCTGACCAA GAACCAGGTCAGCCTGACCTGCCTGGTCAAAGGC TTCTATCCCAGCGACATCGCCGTGGAGTGGGAGA GCAATGGGCAGCCGGAGAACAACTACAAGACCAC GCCTCCCGTGCTGGACTCCGACGGCTCCTTCTTC CTCTACAGCAAGCTCACCGTGGACAAGAGCAGGT GGCAGCAGGGGAACGTCTTCTCATGCTCCGTGAT GCATGAGGCTCTGCACAACCACTACACGCAGAAG TCCCTCTCCCTGTCTCCGGGTAAATGA | |
| | LC | CAGTCTGCCCTGACTCAGCCTGCCTCCGTGTCTG GGTCTCCTGGACAGTCGATCACCATCTCCTGCAC TGGAACCAGCAGTGACGTTGGTGGTTATAACTAT GTCTCCTGGTACCAACAACACCCAGGCAAAGCCC CCAAACTCATGATTTATGATGTCAGTAAGCGGCC CTCAGGGGTTTCTAATCGCTTCTCTGGCTCCAAG TCTGGCAACACGGCCTCCCTGACCATCTCTGGGC TCCAGTCTGAGGACGAGGCTGATTATTACTGCAA CTCTTTGACAAGCATCAGCACTTGGGTGTTCGGC GGAGGGACCAAGCTGACCGTCCTAGGCCAGCCCA AGGCCGCCCCCTCCGTGACCCTGTTCCCCCCCTC CTCCGAGGAGCTGCAGGCCAACAAGGCCACCCTG GTGTGCCTGATCTCCGACTTCTACCCCGGCGCCG TGACCGTGGCCTGGAAGGCCGACTCCTCCCCCGT GAAGGCCGGCGTGGAGACCACCACCCCCTCCAAG CAGTCCAACAACAAGTACGCCGCCTCCTCCTACC TGTCCCTGACCCCCGAGCAGTGGAAGTCCCACCG GTCCTACTCCTGCCAGGTGACCCACGAGGGCTCC ACCGTGGAGAAGACCGTGGCCCCCACCGAGTGCT CCTGA | 655 |
| mAb10989 | | Amino Acids | |
| | HCVR | QVQLVQSGAEVKKPGASVKVSCKASGYIFTGYYM HWVRQAPGQGLEWMGWINPNSGGANYAQKFQGRV TLTRDTSITTVYMELSRLRFDDTAVYYCARGSRY DWNQNNWFDPWGQGTLVTVSS | 678 |
| | HCDR1 | GYIFTGYY | 680 |
| | HCDR2 | INPNSGGA | 682 |
| | HCDR3 | ARGSRYDWNQNNWFDP | 684 |
| | LCVR | QSALTQPASVSGSPGQSITISCTGTSSDVGTYNY VSWYQQHPGKAPKLMIFDVSNRPSGVSDRFSGSK SGNTASLTISGLQAEDEADYYCSSFTTSSTVVFG GGTKLTVL | 686 |

-continued

| Antibody Designation | Component Part | Sequence | SEQ ID NO |
|---|---|---|---|
| | LCDR1 | SSDVGTYNY | 688 |
| | LCDR2 | DVS | 650 |
| | LCDR3 | SSFTTSSTVV | 690 |
| | HC | QVQLVQSGAEVKKPGASVKVSCKASGYIFTGYYM HWVRQAPGQGLEWMGWINPNSGGANYAQKFQGRV TLTRDTSITTVYMELSRLRFDDTAVYYCARGSRY DWNQNNWFDPWGQGTLVTVSSASTKGPSVFPLAP SSKSTSGGTAALGCLVKDYFPEPVTVSWNSGALT SGVHTFPAVLQSSGLYSLSSVVTVPSSSLGTQTY ICNVNHKPSNTKVDKKVEPKSCDKTHTCPPCPAP ELLGGPSVFLFPPKPKDTLMISRTPEVTCVVVDV SHEDPEVKFNWYVDGVEVHNAKTKPREEQYNSTY RVVSVLTVLHQDWLNGKEYKCKVSNKALPAPIEK TISKAKGQPREPQVYTLPPSRDELTKNQVSLTCL VKGFYPSDIAVEWESNGQPENNYKTTPPVLDSDG SFFLYSKLTVDKSRWQQGNVFSCSVMHEALHNHY TQKSLSLSPGK | 692 |
| | LC | QSALTQPASVSGSPGQSITISCTGTSSDVGTYNY VSWYQQHPGKAPKLMIFDVSNRPSGVSDRFSGSK SGNTASLTISGLQAEDEADYYCSSFTTSSTVVFG GGTKLTVLGQPKAAPSVTLFPPSSEELQANKATL VCLISDFYPGAVTVAWKADSSPVKAGVETTTPSK QSNNKYAASSYLSLTPEQWKSHRSYSCQVTHEGS TVEKTVAPTECS | 694 |
| | | Nucleic Acids | |
| | HCVR | CAGGTGCAGCTGGTGCAGTCTGGGGCTGAGGTGA AGAAGCCTGGGGCCTCAGTGAAGGTCTCCTGCAA GGCTTCTGGATACATCTTCACCGGCTACTATATG CACTGGGTGCGACAGGCCCCTGGACAGGGGCTTG AGTGGATGGGATGGATCAACCCTAACAGTGGTGG CGCAAACTATGCACAGAAGTTTCAGGGCAGGGTC ACCCTGACCAGGGACACGTCCATCACCACAGTCT ACATGGAACTGAGCAGGCTGAGATTTGACGACAC GGCCGTGTATTACTGTGCGAGAGGATCCCGGTAT GACTGGAACCAGAACAACTGGTTCGACCCCTGGG GCCAGGGAACCCTGGTCACCGTCTCCTCA | 677 |
| | HCDR1 | GGATACATCTTCACCGGCTACTAT | 679 |
| | HCDR2 | ATCAACCCTAACAGTGGTGGCGCA | 681 |
| | HCDR3 | GCGAGAGGATCCCGGTATGACTGGAACCAGAACA ACTGGTTCGACCCC | 683 |
| | LCVR | CAGTCTGCCCTGACTCAGCCTGCCTCCGTGTCTG GGTCTCCTGGACAGTCGATCACCATCTCCTGCAC TGGAACCAGCAGTGACGTTGGTACTTATAACTAT GTCTCCTGGTACCAACAACACCCAGGCAAAGCCC CCAAACTCATGATTTTTGATGTCAGTAATCGGCC CTCAGGGGTTTCTGATCGCTTCTCTGGCTCCAAG TCTGGCAACACGGCCTCCCTGACCATCTCTGGGC TCCAGGCTGAGGACGAGGCTGATTATTACTGCAG CTCATTTACAACCAGCAGCACTGTGGTTTTCGGC GGAGGGACCAAGCTGACCGTCCTA | 685 |
| | LCDR1 | AGCAGTGACGTTGGTACTTATAACTAT | 687 |
| | LCDR2 | GATGTCAGT | 649 |
| | LCDR3 | AGCTCATTTACAACCAGCAGCACTGTGGTT | 689 |
| | HC | CAGGTGCAGCTGGTGCAGTCTGGGGCTGAGGTGA AGAAGCCTGGGGCCTCAGTGAAGGTCTCCTGCAA GGCTTCTGGATACATCTTCACCGGCTACTATATG CACTGGGTGCGACAGGCCCCTGGACAGGGGCTTG AGTGGATGGGATGGATCAACCCTAACAGTGGTGG CGCAAACTATGCACAGAAGTTTCAGGGCAGGGTC ACCCTGACCAGGGACACGTCCATCACCACAGTCT ACATGGAACTGAGCAGGCTGAGATTTGACGACAC GGCCGTGTATTACTGTGCGAGAGGATCCCGGTAT | 691 |

-continued

| Antibody Designation | Component Part | Sequence | SEQ ID NO |
|---|---|---|---|
| | | GACTGGAACCAGAACAACTGGTTCGACCCCTGGG<br>GCCAGGGAACCCTGGTCACCGTCTCCTCAGCCTC<br>CACCAAGGGCCCATCGGTCTTCCCCCTGGCACCC<br>TCCTCCAAGAGCACCTCTGGGGGCACAGCGGCCC<br>TGGGCTGCCTGGTCAAGGACTACTTCCCCGAACC<br>GGTGACGGTGTCGTGGAACTCAGGCGCCCTGACC<br>AGCGGCGTGCACACCTTCCCGGCTGTCCTACAGT<br>CCTCAGGACTCTACTCCCTCAGCAGCGTGGTGAC<br>CGTGCCCTCCAGCAGCTTGGGCACCCAGACCTAC<br>ATCTGCAACGTGAATCACAAGCCCAGCAACACCA<br>AGGTGGACAAGAAAGTTGAGCCCAAATCTTGTGA<br>CAAAACTCACACATGCCCACCGTGCCCAGCACCT<br>GAACTCCTGGGGGGACCGTCAGTCTTCCTCTTCC<br>CCCCAAAACCCAAGGACACCCTCATGATCTCCCG<br>GACCCCTGAGGTCACATGCGTGGTGGTGGACGTG<br>AGCCACGAAGACCCTGAGGTCAAGTTCAACTGGT<br>ACGTGGACGGCGTGGAGGTGCATAATGCCAAGAC<br>AAAGCCGCGGGAGGAGCAGTACAACAGCACGTAC<br>CGTGTGGTCAGCGTCCTCACCGTCCTGCACCAGG<br>ACTGGCTGAATGGCAAGGAGTACAAGTGCAAGGT<br>CTCCAACAAAGCCCTCCCAGCCCCCATCGAGAAA<br>ACCATCTCCAAAGCCAAAGGGCAGCCCCGAGAAC<br>CACAGGTGTACACCCTGCCCCCATCCCGGGATGA<br>GCTGACCAAGAACCAGGTCAGCCTGACCTGCCTG<br>GTCAAAGGCTTCTATCCCAGCGACATCGCCGTGG<br>AGTGGGAGAGCAATGGGCAGCCGGAGAACAACTA<br>CAAGACCACGCCTCCCGTGCTGGACTCCGACGGC<br>TCCTTCTTCCTCTACAGCAAGCTCACCGTGGACA<br>AGAGCAGGTGGCAGCAGGGGAACGTCTTCTCATG<br>CTCCGTGATGCATGAGGCTCTGCACAACCACTAC<br>ACGCAGAAGTCCCTCTCCCTGTCTCCGGGTAAAT<br>GA | |
| | LC | CAGTCTGCCCTGACTCAGCCTGCCTCCGTGTCTG<br>GGTCTCCTGGACAGTCGATCACCATCTCCTGCAC<br>TGGAACCAGCAGTGACGTTGGTACTTATAACTAT<br>GTCTCCTGGTACCAACAACACCCAGGCAAAGCCC<br>CCAAACTCATGATTTTTGATGTCAGTAATCGGCC<br>CTCAGGGGTTTCTGATCGCTTCTCTGGCTCCAAG<br>TCTGGCAACACGGCCTCCCTGACCATCTCTGGGC<br>TCCAGGCTGAGGACGAGGCTGATTATTACTGCAG<br>CTCATTTACAACCAGCAGCACTGTGGTTTTCGGC<br>GGAGGGACCAAGCTGACCGTCCTAGGCCAGCCCA<br>AGGCCGCCCCCTCCGTGACCCTGTTCCCCCCCTC<br>CTCCGAGGAGCTGCAGGCCAACAAGGCCACCCTG<br>GTGTGCCTGATCTCCGACTTCTACCCCGGCGCCG<br>TGACCGTGGCCTGGAAGGCCGACTCCTCCCCCGT<br>GAAGGCCGGCGTGGAGACCACCACCCCCTCCAAG<br>CAGTCCAACAACAAGTACGCCGCCTCCTCCTACC<br>TGTCCCTGACCCCCGAGCAGTGGAAGTCCCACCG<br>GTCCTACTCCTGCCAGGTGACCCACGAGGGCTCC<br>ACCGTGGAGAAGACCGTGGCCCCCACCGAGTGCT<br>CCTGA | 693 |

Administration of Antibodies

The present invention provides methods for administering an anti-CoV-S antigen-binding protein of the present invention, e.g., those of Table 1, comprising introducing the antigen-binding protein into the body of a subject (e.g., a human). For example, the method comprises piercing the body of the subject with a needle of a syringe and injecting the antigen-binding protein into the body of the subject, e.g., into the vein, artery, tumor, muscular tissue or subcutis of the subject.

The present invention provides a vessel (e.g., a plastic or glass vial, e.g., with a cap or a chromatography column, hollow bore needle or a syringe cylinder) comprising an anti-CoV-S antigen-binding protein of the present invention, e.g., those of Table 1.

The present invention also provides an injection device comprising one or more antigen-binding proteins (e.g., antibody or antigen-binding fragment) that bind specifically to CoV-S, e.g., those of Table 1, or a pharmaceutical composition thereof. The injection device may be packaged into a kit. An injection device is a device that introduces a substance into the body of a subject via a parenteral route, e.g., intramuscular, subcutaneous or intravenous. For example, an injection device may be a syringe (e.g., pre-filled with the pharmaceutical composition, such as an auto-injector) which, for example, includes a cylinder or barrel for holding fluid to be injected (e.g., comprising the antibody or fragment or a pharmaceutical composition thereof), a needle for piecing skin and/or blood vessels for injection of the fluid; and a plunger for pushing the fluid out of the cylinder and through the needle bore. In an embodiment of the invention, an injection device that comprises an antigen-binding protein, e.g., an antibody or antigen-binding fragment thereof, from a combination of the present invention, or a pharmaceutical composition thereof is an intravenous (IV) injection device. Such a device can include the antigen-binding protein or a pharmaceutical composition thereof in a cannula or trocar/needle which may be attached to a tube which may be attached to a bag or reservoir for holding fluid (e.g., saline) introduced into the body of the subject through the cannula or trocar/needle. The antibody or fragment or a pharmaceutical composition thereof may, in an embodiment of the invention, be introduced into the device once the trocar and cannula are inserted into the vein of a subject and the trocar is removed from the inserted cannula. The IV device may, for example, be inserted into a peripheral vein (e.g., in the hand or arm); the superior vena cava or inferior vena cava, or within the right atrium of the heart (e.g., a central IV); or into a subclavian, internal jugular, or a femoral vein and, for example, advanced toward the heart until it reaches the superior vena cava or right atrium (e.g., a central venous line). In an embodiment of the invention, an injection device is an autoinjector; a jet injector or an external infusion pump. A jet injector uses a high-pressure narrow jet of liquid which penetrate the epidermis to introduce the antibody or fragment or a pharmaceutical composition thereof to a subject's body. External infusion pumps are medical devices that deliver the antibody or fragment or a pharmaceutical composition thereof into a subject's body in controlled amounts. External infusion pumps may be powered electrically or mechanically. Different pumps operate in different ways, for example, a syringe pump holds fluid in the reservoir of a syringe, and a moveable piston controls fluid delivery, an elastomeric pump holds fluid in a stretchable balloon reservoir, and pressure from the elastic walls of the balloon drives fluid delivery. In a peristaltic pump, a set of rollers pinches down on a length of flexible tubing, pushing fluid forward. In a multi-channel pump, fluids can be delivered from multiple reservoirs at multiple rates.

Preparation of Human Antibodies

Methods for generating human antibodies in transgenic mice are known in the art. Any such known methods can be used in the context of the present invention to make human antibodies that specifically bind to CoV-S. An immunogen comprising any one of the following can be used to generate antibodies to CoV-S. In certain embodiments of the invention, the antibodies of the invention are obtained from mice immunized with a full length, native CoV-S, or with a live attenuated or inactivated virus, or with DNA encoding the protein or fragment thereof. Alternatively, the CoV-S protein or a fragment thereof may be produced using standard biochemical techniques and modified and used as immunogen. In one embodiment of the invention, the immunogen is a recombinantly produced CoV-S protein or fragment thereof. In certain embodiments of the invention, the immunogen may be a CoV-S polypeptide vaccine. In certain embodiments, one or more booster injections may be administered. In certain embodiments, the immunogen may be a recombinant CoV-S polypeptide expressed in *E. coli* or in any other eukaryotic or mammalian cells such as Chinese hamster ovary (CHO) cells.

Using VELOCIMMUNE® technology (see, for example, U.S. Pat. No. 6,596,541, Regeneron Pharmaceuticals, VELOCIMMUNE®) or any other known method for generating monoclonal antibodies, high affinity chimeric antibodies to CoV-S can be initially isolated having a human variable region and a mouse constant region. The VELOCIMMUNE® technology involves generation of a transgenic mouse having a genome comprising human heavy and light chain variable regions operably linked to endogenous mouse constant region loci such that the mouse produces an antibody comprising a human variable region and a mouse constant region in response to antigenic stimulation. The DNA encoding the variable regions of the heavy and light chains of the antibody are isolated and operably linked to DNA encoding the human heavy and light chain constant regions. The DNA is then expressed in a cell capable of expressing the fully human antibody.

Generally, a VELOCIMMUNE® mouse is challenged with the antigen of interest, and lymphatic cells (such as B-cells) are recovered from the mice that express antibodies. The lymphatic cells may be fused with a myeloma cell line to prepare immortal hybridoma cell lines, and such hybridoma cell lines are screened and selected to identify hybridoma cell lines that produce antibodies specific to the antigen of interest. DNA encoding the variable regions of the heavy chain and light chain may be isolated and linked to desirable isotypic constant regions of the heavy chain and light chain. Such an antibody protein may be produced in a cell, such as a CHO cell. Alternatively, DNA encoding the antigen-specific chimeric antibodies or the variable domains of the light and heavy chains may be isolated directly from antigen-specific lymphocytes.

Initially, high affinity chimeric antibodies are isolated having a human variable region and a mouse constant region. As in the experimental section below, the antibodies are characterized and selected for desirable characteristics, including affinity, selectivity, epitope, etc. The mouse constant regions are replaced with a desired human constant region to generate the fully human antibody of the invention, for example wild-type or modified IgG1 or IgG4. While the constant region selected may vary according to specific use, high affinity antigen-binding and target specificity characteristics reside in the variable region.

Anti-Coronavirus Spike Protein Antibodies Comprising Fc Variants

According to certain embodiments of the present invention, anti-CoV-S antigen-binding proteins, e.g., antibodies or antigen-binding fragments, are provided comprising an Fc domain comprising one or more mutations, which, for example, enhance or diminish antibody binding to the FcRn receptor, e.g., at acidic pH as compared to neutral pH. For example, the present invention includes anti-CoV-S antibodies comprising a mutation in the $C_H2$ or a $C_H3$ region of the Fc domain, wherein the mutation(s) increases the affinity of the Fc domain to FcRn in an acidic environment (e.g., in an endosome where pH ranges from about 5.5 to about 6.0). Such mutations may result in an increase in serum half-life of the antibody when administered to an animal. Non-limiting examples of such Fc modifications include, e.g., a modification at position 250 (e.g., E or Q); 250 and 428 (e.g., L or F); 252 (e.g., L/Y/F/W or T), 254 (e.g., S or T), and 256 (e.g., S/R/Q/E/D or T); or a modification at position 428 and/or 433 (e.g., H/L/R/S/P/Q or K) and/or 434 (e.g., A, W, H, F or Y [N434A, N434W, N434H, N434F or N434Y]); or a modification at position 250 and/or 428; or a modification at position 307 or 308 (e.g., 308F, V308F), and 434. In one embodiment, the modification comprises a 428L (e.g., M428L) and 434S (e.g., N434S) modification; a 428L, 259I (e.g., V259I), and 308F (e.g., V308F) modification; a 433K (e.g., H433K) and a 434 (e.g., 434Y) modification; a 252, 254, and 256 (e.g., 252Y, 254T, and 256E) modification; a 250Q and 428L modification (e.g., T250Q and M428L); and a 307 and/or 308 modification (e.g., 308F or 308P). In yet another embodiment, the modification comprises a 265A (e.g., D265A) and/or a 297A (e.g., N297A) modification.

For example, the present invention includes anti-CoV-S antigen-binding proteins, e.g., antibodies or antigen-binding fragments, comprising an Fc domain comprising one or more pairs or groups of mutations selected from the group consisting of: 250Q and 248L (e.g., T250Q and M248L); 252Y, 254T and 256E (e.g., M252Y, S254T and T256E); 428L and 434S (e.g., M428L and N434S); 257I and 311I (e.g., P257I and Q311I); 257I and 434H (e.g., P257I and N434H); 376V and 434H (e.g., D376V and N434H); 307A, 380A and 434A (e.g., T307A, E380A and N434A); and 433K and 434F (e.g., H433K and N434F).

Anti-CoV-S antigen-binding proteins, e.g., antibodies and antigen-binding fragments thereof, that comprise a $V_H$ and/or $V_L$ as set forth herein comprising any possible combinations of the foregoing Fc domain mutations, are contemplated within the scope of the present invention.

The present invention also includes anti-CoV-S antigen-binding proteins, antibodies or antigen-binding fragments, comprising a $V_H$ set forth herein and a chimeric heavy chain constant ($C_H$) region, wherein the chimeric $C_H$ region comprises segments derived from the $C_H$ regions of more than one immunoglobulin isotype. For example, the antibodies of the invention may comprise a chimeric $C_H$ region comprising part or all of a $C_H2$ domain derived from a human IgG1, human IgG2 or human IgG4 molecule, combined with part or all of a $C_H3$ domain derived from a human IgG1, human IgG2 or human IgG4 molecule. According to certain embodiments, the antibodies of the invention comprise a chimeric $C_H$ region having a chimeric hinge region. For example, a chimeric hinge may comprise an "upper hinge" amino acid sequence (amino acid residues from positions 216 to 227 according to EU numbering) derived from a human IgG1, a human IgG2 or a human IgG4 hinge region, combined with a "lower hinge" sequence (amino acid residues from positions 228 to 236 according to EU numbering) derived from a human IgG1, a human IgG2 or a human IgG4 hinge region. According to certain embodiments, the chimeric hinge region comprises amino acid residues derived from a human IgG1 or a human IgG4 upper hinge and amino acid residues derived from a human IgG2 lower hinge. An antibody comprising a chimeric $C_H$ region as described herein may, in certain embodiments, exhibit modified Fc effector functions without adversely affecting the therapeutic or pharmacokinetic properties of the antibody. (See, e.g., WO2014/022540).

Immunoconjugates

The invention encompasses an anti-CoV-S antigen-binding proteins, e.g., antibodies or antigen-binding fragments, conjugated to another moiety, e.g., a therapeutic moiety (an "immunoconjugate"), such as a toxoid or an anti-viral drug to treat influenza virus infection. In an embodiment of the invention, an anti-CoV-S antibody or fragment is conjugated to any of the further therapeutic agents set forth herein. As used herein, the term "immunoconjugate" refers to an antigen-binding protein, e.g., an antibody or antigen-binding fragment, which is chemically or biologically linked to a radioactive agent, a cytokine, an interferon, a target or reporter moiety, an enzyme, a peptide or protein or a therapeutic agent. The antigen-binding protein may be linked to the radioactive agent, cytokine, interferon, target or reporter moiety, enzyme, peptide or therapeutic agent at any location along the molecule so long as it is able to bind its target (CoV-S). Examples of immunoconjugates include antibody-drug conjugates and antibody-toxin fusion proteins. In one embodiment of the invention, the agent may be a second, different antibody that binds specifically to CoV-S. The type of therapeutic moiety that may be conjugated to the anti-CoV-S antigen-binding protein (e.g., antibody or fragment) will take into account the condition to be treated and the desired therapeutic effect to be achieved. See, e.g., Arnon et al., "Monoclonal Antibodies For Immunotargeting Of Drugs In Cancer Therapy", Monoclonal Antibodies And Cancer Therapy, Reisfeld et al. (eds.), pp. 243-56 (Alan R. Liss, Inc. 1985); Hellstrom et al., "Antibodies For Drug Delivery", Controlled Drug Delivery ($2^{nd}$ Ed.), Robinson et al. (eds.), pp. 623-53 (Marcel Dekker, Inc. 1987); Thorpe, "Antibody Carriers Of Cytotoxic Agents In Cancer Therapy: A Review", Monoclonal Antibodies 1984: Biological And Clinical Applications, Pinchera et al. (eds.), pp. 475-506 (1985); "Analysis, Results, And Future Prospective Of The Therapeutic Use Of Radiolabeled Antibody In Cancer Therapy", Monoclonal Antibodies For Cancer Detection And Therapy, Baldwin et al. (eds.), pp. 303-16 (Academic Press 1985), and Thorpe et al., "The Preparation And Cytotoxic Properties Of Antibody-Toxin Conjugates", Immunol. Rev., 62: 119-58 (1982).

Multi-Specific Antibodies

The present invention includes anti-CoV-S antigen-binding proteins, e.g., antibodies and antigen-binding fragments thereof, as well as methods of use thereof and methods of making such antigen-binding proteins. The term "anti-CoV-S" antigen-binding proteins, e.g., antibodies or antigen-binding fragments, includes multispecific (e.g., bispecific or biparatopic) molecules that include at least one first antigen-binding domain that specifically binds to CoV-S (e.g., an antigen-binding domain from an antibody of Table 1) and at least one second antigen-binding domain that binds to a different antigen or to an epitope in CoV-S which is different from that of the first antigen-binding domain. In some embodiments, the first antigen-binding domain and the second antigen-binding domain are both selected from the antigen-binding domains of Table 1. In an embodiment of the invention, the first and second epitopes overlap. In another embodiment of the invention, the first and second epitopes do not overlap. For example, in an embodiment of the invention, a multispecific antibody is a bispecific IgG antibody (e.g., IgG1 or IgG4) that includes a first antigen-binding domain that binds specifically to CoV-S including the heavy and light immunoglobulin chain of an antibody of Table 1, and a second antigen-binding domain that binds specifically to a different epitope of CoV-S. In some embodiments, a bispecific IgG antibody (e.g., IgG1 or IgG4) includes a first antigen-binding domain that binds specifically to CoV-S and a second binding domain that binds to a host cell protein, e.g., ACE2 or TMPRSS2.

The antibodies of Table 1 include multispecific molecules, e.g., antibodies or antigen-binding fragments, that include the CDR-Hs and CDR-Ls, $V_H$ and $V_L$, or HC and LC of those antibodies, respectively (including variants thereof as set forth herein).

In an embodiment of the invention, an antigen-binding domain that binds specifically to CoV-S, which may be included in a multispecific molecule, comprises:

(1)

(i) a heavy chain variable domain sequence that comprises CDR-H1, CDR-H2, and CDR-H3 amino acid sequences set forth in Table 1, and (ii) a light chain variable domain sequence that comprises CDR-L1, CDR-L2, and CDR-L3 amino acid sequences set forth in Table 1;

or, (2)

(i) a heavy chain variable domain sequence comprising an amino acid sequence set forth in Table 1, and (ii) a light chain variable domain sequence comprising an amino acid sequence set forth in Table 1;

or, (3)

(i) a heavy chain immunoglobulin sequence comprising an amino acid sequence set forth in Table 1, and (ii) a light chain immunoglobulin sequence comprising an amino acid sequence set forth in Table 1.

In an embodiment of the invention, the multispecific antibody or fragment includes more than two different binding specificities (e.g., a trispecific molecule), for example, one or more additional antigen-binding domains which are the same or different from the first and/or second antigen-binding domain.

In one embodiment of the invention, a bispecific antigen-binding fragment comprises a first scFv (e.g., comprising $V_H$ and $V_L$ sequences of Table 1) having binding specificity for a first epitope (e.g., CoV-S) and a second scFv having binding specificity for a second, different epitope. For example, in an embodiment of the invention, the first and second scFv are tethered with a linker, e.g., a peptide linker (e.g., a GS linker such as $(GGGGS)_n$ (SEQ ID NO: 834) wherein n is, for example, 1, 2, 3, 4, 5, 6, 7, 8, 9 or 10). Other bispecific antigen-binding fragments include an $F(ab)_2$ of a bispecific IgG antibody which comprises the heavy and light chain CDRs of Table 1 and of another antibody that binds to a different epitope.

Therapeutic Methods

The present invention provides methods for treating or preventing viral infection (e.g., coronavirus infection) by administering a therapeutically effective amount of anti-CoV-S antigen-binding protein, e.g., antibody or antigen-binding fragment, (e.g., of Table 1) to a subject (e.g., a human) in need of such treatment or prevention.

Coronavirus infection may be treated or prevented, in a subject, by administering an anti-CoV-S antigen-binding protein of the present invention to a subject.

An effective or therapeutically effective dose of anti-CoV-S antigen-binding protein, e.g., antibody or antigen-binding fragment (e.g., of Table 1), for treating or preventing a viral infection refers to the amount of the antibody or fragment sufficient to alleviate one or more signs and/or symptoms of the infection in the treated subject, whether by inducing the regression or elimination of such signs and/or symptoms or by inhibiting the progression of such signs and/or symptoms. The dose amount may vary depending upon the age and the size of a subject to be administered, target disease, conditions, route of administration, and the like. In an embodiment of the invention, an effective or therapeutically effective dose of antibody or antigen-binding fragment thereof of the present invention, for treating or preventing viral infection, e.g., in an adult human subject, is about 0.01 to about 200 mg/kg, e.g., up to about 150 mg/kg. In an embodiment of the invention, the dosage is up to about 10.8 or 11 grams (e.g., about 1, 2, 3, 4, 5, 6, 7, 8, 9, 10 or 11 grams). Depending on the severity of the infection, the frequency and the duration of the treatment can be adjusted. In certain embodiments, the antigen-binding protein of the present invention can be administered at an initial dose, followed by one or more secondary doses. In certain embodiments, the initial dose may be followed by administration of a second or a plurality of subsequent doses of antibody or antigen-binding fragment thereof in an amount that can be approximately the same or less than that of the initial dose, wherein the subsequent doses are separated by at least 1 day to 3 days; at least one week, at least 2 weeks; at least 3 weeks; at least 4 weeks; at least 5 weeks; at least 6 weeks; at least 7 weeks; at least 8 weeks; at least 9 weeks; at least 10 weeks; at least 12 weeks; or at least 14 weeks.

As used herein, the term "subject" refers to a mammal (e.g., rat, mouse, cat, dog, cow, pig, sheep, horse, goat, rabbit), preferably a human, for example, in need of prevention and/or treatment of a disease or disorder such as viral infection or cancer. The subject may have a viral infection, e.g., an influenza infection, or be predisposed to developing an infection. Subjects predisposed to developing an infection, or subjects who may be at elevated risk for contracting an infection (e.g., of coronavirus or influenza virus), include subjects with compromised immune systems because of autoimmune disease, subjects receiving immunosuppressive therapy (for example, following organ transplant), subjects afflicted with human immunodeficiency syndrome (HIV) or acquired immune deficiency syndrome (AIDS), subjects with forms of anemia that deplete or destroy white blood cells, subjects receiving radiation or chemotherapy, or subjects afflicted with an inflammatory disorder. Additionally, subjects of very young (e.g., 5 years of age or younger) or old age (e.g., 65 years of age or older) are at increased risk. Moreover, a subject may be at risk of contracting a viral infection due to proximity to an outbreak of the disease, e.g. subject resides in a densely-populated city or in close proximity to subjects having confirmed or suspected infections of a virus, or choice of employment, e.g. hospital worker, pharmaceutical researcher, traveler to infected area, or frequent flier.

"Treat" or "treating" means to administer an anti-CoV-S antigen-binding protein, e.g., antibody or antigen-binding fragment of the present invention (e.g., of Table 1), to a subject having one or more signs or symptoms of a disease or infection, e.g., viral infection, for which the antigen-binding protein is effective when administered to the subject at an effective or therapeutically effective amount or dose (as discussed herein).

The present invention also encompasses prophylactically administering an anti-CoV-S antigen-binding protein, e.g., antibody or antigen-binding fragment thereof of the present invention (e.g., of Table 1), to a subject who is at risk of viral infection so as to prevent such infection. Passive antibody-based immunoprophylaxis has proven an effective strategy for preventing subject from viral infection. See e.g., Berry et al., Passive broad-spectrum influenza immunoprophylaxis. Influenza Res Treat. 2014; 2014:267594. Epub 2014 Sep. 22; and Jianqiang et al., Passive immune neutralization strategies for prevention and control of influenza A infections, Immunotherapy. 2012 February; 4(2): 175-186; Prabhu et al., Antivir Ther. 2009; 14(7):911-21, Prophylactic and therapeutic efficacy of a chimeric monoclonal antibody specific for H5 hemagglutinin against lethal H5N1 influenza. "Prevent" or "preventing" means to administer an anti-CoV-S antigen-binding protein, e.g., antibody or antigen-binding fragment of the present invention (e.g., of Table 1), to a subject to inhibit the manifestation of a disease or infection (e.g., viral infection) in the body of a subject, for which the antigen-binding protein is effective when administered to the subject at an effective or therapeutically effective amount or dose (as discussed herein).

In an embodiment of the invention, a sign or symptom of a viral infection in a subject is survival or proliferation of virus in the body of the subject, e.g., as determined by viral titer assay (e.g., coronavirus propagation in embryonated chicken eggs or coronavirus spike protein assay). Other signs and symptoms of viral infection are discussed herein.

As noted above, in some embodiments the subject may be a non-human animal, and the antigen-binding proteins (e.g., antibodies and antigen-binding fragments) discussed herein may be used in a veterinary context to treat and/or prevent disease in the non-human animals (e.g., cats, dogs, pigs, cows, horses, goats, rabbits, sheep, and the like).

The present invention provides a method for treating or preventing viral infection (e.g., coronavirus infection) or for inducing the regression or elimination or inhibiting the progression of at least one sign or symptom of viral infection such as:

fever or feeling feverish/chills;
cough;
sore throat;
runny or stuffy nose;
sneezing;
muscle or body aches;
headaches;
fatigue (tiredness);
vomiting;
diarrhea;
respiratory tract infection;
chest discomfort;
shortness of breath;
bronchitis; and/or
pneumonia, which sign or symptom is secondary to viral infection, in a subject in need thereof (e.g., a human), by administering a therapeutically effective amount of anti-CoV-S antigen-binding protein (e.g., of Table 1) to the subject, for example, by injection of the protein into the body of the subject.

Combinations and Pharmaceutical Compositions

To prepare pharmaceutical compositions of the anti-CoV-S antigen-binding proteins, e.g., antibodies and antigen-binding fragments thereof (e.g., of Table 1), antigen-binding protein is admixed with a pharmaceutically acceptable carrier or excipient. See, e.g., Remington's Pharmaceutical Sciences and U.S. Pharmacopeia: National Formulary, Mack Publishing Company, Easton, Pa. (1984); Hardman, et al. (2001) Goodman and Gilman's The Pharmacological Basis of Therapeutics, McGraw-Hill, New York, N.Y.; Gennaro (2000) Remington: The Science and Practice of Pharmacy, Lippincott, Williams, and Wilkins, New York, N.Y.; Avis, et al. (eds.) (1993) Pharmaceutical Dosage Forms: Parenteral Medications, Marcel Dekker, NY; Lieberman, et al. (eds.) (1990) Pharmaceutical Dosage Forms: Tablets, Marcel Dekker, NY; Lieberman, et al. (eds.) (1990) Pharmaceutical Dosage Forms: Disperse Systems, Marcel Dekker, NY; Weiner and Kotkoskie (2000) Excipient Toxicity and Safety, Marcel Dekker, Inc., New York, N.Y. In an embodiment of the invention, the pharmaceutical composition is sterile. Such compositions are part of the present invention.

The scope of the present invention includes desiccated, e.g., freeze-dried, compositions comprising an anti-CoV-S antigen-binding proteins, e.g., antibody or antigen-binding fragment thereof (e.g., of Table 1), or a pharmaceutical composition thereof that includes a pharmaceutically acceptable carrier but substantially lacks water.

In a further embodiment of the invention, a further therapeutic agent that is administered to a subject in association with an anti-CoV-S antigen-binding protein, e.g., antibody or antigen-binding fragment thereof (e.g., of Table 1), disclosed herein is administered to the subject in accordance with the Physicians' Desk Reference 2003 (Thomson Healthcare; $57^{th}$ edition (Nov. 1, 2002)).

The mode of administration can vary. Routes of administration include oral, rectal, transmucosal, intestinal, parenteral; intramuscular, subcutaneous, intradermal, intramedullary, intrathecal, direct intraventricular, intravenous, intraperitoneal, intranasal, intraocular, inhalation, insufflation, topical, cutaneous, transdermal or intra-arterial.

The present invention provides methods for administering an anti-CoV-S antigen-binding protein, e.g., antibody or antigen-binding fragment thereof (e.g., of Table 1), comprising introducing the protein into the body of a subject. For example, the method comprises piercing the body of the subject with a needle of a syringe and injecting the antigen-binding protein into the body of the subject, e.g., into the vein, artery, tumor, muscular tissue or subcutis of the subject.

The present invention provides a vessel (e.g., a plastic or glass vial, e.g., with a cap or a chromatography column, hollow bore needle or a syringe cylinder) comprising any of the anti-CoV-S antigen-binding proteins, e.g., antibodies or antigen-binding fragments thereof (e.g., of Table 1), polypeptides (e.g., an HC, LC, $V_H$ or $V_L$ of Table 1) or polynucleotides (e.g., of Table 2) or vectors set forth herein or a pharmaceutical composition thereof comprising a pharmaceutically acceptable carrier.

In an embodiment of the present disclosure, an anti-CoV-S antigen-binding protein, e.g., antibody or antigen-binding fragment thereof of the present invention (e.g., of Table 1), is administered in association with one or more further therapeutic agents. A further therapeutic agent includes, but is not limited to: an anti-inflammatory agent, an antimalarial agent, a second antibody or antigen-binding fragment thereof that specifically binds TMPRSS2, and a second antibody or antigen-binding fragment thereof that specifically binds to CoV-S. In some embodiments, an antimalarial agent is chloroquine or hydroxychloroquine. In some embodiments, an anti-inflammatory agent is an antibody such as sarilumab, tocilizumab, or gimsilumab. In some embodiments, the further therapeutic agent is a second antibody or antigen-binding fragment disclosed herein, e.g., of Table 1. In certain embodiments, one, t three, four, or more antibodies, or antigen-binding fragments thereof, of Table 1 can be administered in combination (e.g., concurrently or sequentially). In certain embodiments, the two, three, four, or more antibodies bind to non-overlapping, or partially overlapping, epitopes of the spike protein, e.g., in the receptor binding domain of the spike protein. Various methods are known in the art for determining whether two or more antibodies have non-overlapping or partially overlapping epitopes such as, for example, a cross-competition assay. Particular combinations of antibodies of Table 1 are listed below (each number representing a specific combination, e.g., mAb0989 and mAb10987 is Combination 1, mAb10989 and mAb10934 is Combination 2, and so on). In some embodiments, a combination of antibodies can be selected from among those binding to different epitope clusters. For example, certain antibodies described herein belong to epitope clusters as follows: Cluster 1, mAb10987, mAb10922, mAb10936, and mAb10934; Cluster 2, mAb10989, mAb10977, and mAb10933; Cluster 3, mAb10920; Cluster 4, mAb10954, mAb10986, and mAb10964; and Cluster 5, mAb10984. Thus, a combination of two antibodies can be selected from, for example, Cluster 1 and Cluster 2, Cluster 1 and Cluster 3, Cluster 1 and Cluster 4, Cluster 1 and Cluster 5, Cluster 2 and Cluster 3, Cluster 2 and Cluster 4, Cluster 2 and Cluster 5, Cluster 3 and Cluster 4, Cluster 3 and Cluster and Cluster 4 and Cluster 5. In certain embodiments, three antibodies can be administered in combination (e.g., concurrently or sequentially). For example, such combinations can be selected from the group consisting of mAb10987 and mAb10933 plus any one of the following antibodies: mAb10913, mAb10915, mAb10916, mAb10917, mAb10918, mAb10920, mAb10921, mAb10922, mAb10923, mAb10924, mAb10925, mAb10926, mAb10927, mAb10928, mAb10929, mAb10930, mAb10931, mAb10932, mAb10934, mAb10935, mAb10936, mAb10937, mAb10940, mAb10938, mAb10939, mAb10941, mAb10942, mAb10943, mAb10944, mAb10945 mAb10946, mAb10947, mAb10948, mAb10949, mAb10951, mAb10950, mAb10954, mAb10955, mAb10956, mAb10957, mAb10958, mAb10959, mAb10960, mAb10961, mAb10964, mAb10965, mAb10966, mAb10967, mAb10969, mAb10970, mAb10971, mAb10973, mAb10974, mAb10975, mAb10976, mAb10977, mAb10978, mAb10979, mAb10980, mAb10981, mAb10982, mAb10983, mAb10984, mAb10985, mAb10986, mAb10988, mAb10989, mAb10990, mAb10991, mAb10992, mAb10993, mAb10994, mAb10995, mAb10996, mAb10997, mAb10998, mAb10999, mAb11000, mAb11001, mAb11002, mAb11003, mAb10914, mAb11004, mAb11005, mAb11006, mAb11007, mAb11008, mAb11009, mAb11010, and mAb11011. In some embodiments, the combination is mAb10933, mAb10987, and mAb10985. None of mAb10933, mAb10987 and mAb10985 were observed to cross-compete with one another. In some embodiments, an antibody that specifically binds TMPRSS2 is H1H7017N, as described in International Patent Pub. No. WO/2019/147831.

| | mAb10989 | mAb10987 | mAb10934 | mAb10933 | mAb10920 | mAb10922 |
|---|---|---|---|---|---|---|
| mAb10989 | X | 1 | 2 | 3 | 4 | 5 |
| mAb10987 | 12 | X | 13 | 14 | 15 | 16 |
| mAb10934 | 23 | 24 | X | 25 | 26 | 27 |
| mAb10933 | 34 | 35 | 36 | X | 37 | 38 |
| mAb10920 | 45 | 46 | 47 | 48 | X | 49 |
| mAb10922 | 56 | 57 | 58 | 59 | 60 | X |
| mAb10936 | 67 | 68 | 69 | 70 | 71 | 72 |
| mAb10954 | 78 | 79 | 80 | 81 | 82 | 83 |
| mAb10964 | 89 | 90 | 91 | 92 | 93 | 94 |
| mAb10977 | 100 | 101 | 102 | 103 | 104 | 105 |
| mAb10984 | 111 | 112 | 113 | 114 | 115 | 116 |
| mAb10986 | 122 | 123 | 124 | 125 | 126 | 127 |

| | mAb10936 | mAb10954 | mAb10964 | mAb10977 | mAb10984 | mAb10986 |
|---|---|---|---|---|---|---|
| mAb10989 | 6 | 7 | 8 | 9 | 10 | 11 |
| mAb10987 | 17 | 18 | 19 | 20 | 21 | 22 |
| mAb10934 | 28 | 29 | 30 | 31 | 32 | 33 |
| mAb10933 | 39 | 40 | 41 | 42 | 43 | 44 |
| mAb10920 | 50 | 51 | 52 | 53 | 54 | 55 |
| mAb10922 | 61 | 62 | 63 | 64 | 65 | 66 |
| mAb10936 | X | 73 | 74 | 75 | 76 | 77 |
| mAb10954 | 84 | X | 85 | 86 | 87 | 88 |
| mAb10964 | 95 | 96 | X | 97 | 98 | 99 |
| mAb10977 | 106 | 107 | 108 | X | 109 | 110 |
| mAb10984 | 117 | 118 | 119 | 120 | X | 121 |
| mAb10986 | 128 | 129 | 130 | 131 | 132 | X |

Because RNA viruses can accumulate mutations over time, a significant concern for any direct antiviral therapeutic is the potential for selection of treatment-induced escape mutants. Strategies to safeguard against escape of antibody therapeutics include selection of a conserved binding epitope or inclusion of multiple antibodies with non-overlapping epitopes. However, the occurrence of escape mutants, and their position, is unpredictable. For example, mutations need not occur at an antibody binding site to be escape mutants. While some informed analysis can be made regarding epitope conservation based on sequence and structural analysis, the possibility of escape still exists under strong selection pressure. Moreover, merely selecting non-overlapping epitopes for treatments with combinations of antibodies may not be sufficient to prevent escape. Rather, the skilled worker will appreciate that a combination of antibodies will be more effective when the antibodies bind to epitopes where a single mutation would be unlikely to disrupt the binding of both antibodies. Because escape mutations can occur outside of the epitope region, and a single mutation has the potential to disrupt binding of one or both antibodies, antibody combinations should be tested for their ability to prevent escape, rather than solely selecting antibodies that bind to non-overlapping epitopes. This further underscores the unpredictability of whether antibodies binding two non-overlapping epitopes would prevent escape, or even whether the antibodies would need to bind non-overlapping epitopes to prevent escape.

Indeed, escape studies performed with anti-influenza HA stem binding antibodies have shown that escape mutants can arise despite high conservation of the stem epitope between diverse influenza subtypes, with some escape mutations arising outside of the antibody epitope region. Furthermore, evaluation of antibodies that demonstrate broad neutralization across multiple species of coronaviruses, and thus may be targeting more conserved residues, shows that neutralization potency of these antibodies is orders of magnitude lower than that of the potent neutralizing antibodies specific for SARS-CoV-2 described herein. Neutralization potency is thought to be the key mechanism of action of anti-SARS-CoV-2 spike antibodies and may prove to be an important driver of clinical efficacy. A clinical candidate selection criterion for broad potency that includes functional assessment against naturally circulating sequence variants and inclusion of multiple antibodies with non-overlapping epitopes may provide enhanced protection against loss of efficacy. Accordingly, in some embodiments of the present disclosure, a combination of potent neutralizing, non-competing, anti-SARS-CoV-2 spike glycoprotein antibodies, as discussed herein, that can deliver optimal antiviral potency while minimizing odds of virus escape, represents an antibody cocktail based therapeutic for treatment and prevention of COVID-19. In particular, escape against multiple non-competing antibodies (e.g., mAb10987 and mAb10933) requires simultaneous selection of two distinct amino acid mutations that allow the virus to maintain replication fitness, a significantly less likely possibility than selection of a single mutation.

In some embodiments, the further therapeutic agent is an anti-viral drug and/or a vaccine. As used herein, the term "anti-viral drug" refers to any anti-infective drug or therapy used to treat, prevent, or ameliorate a viral infection in a subject. The term "anti-viral drug" includes, but is not limited to a cationic steroid antimicrobial, leupeptin, aprotinin, ribavirin, or interferon-alpha2b. Methods for treating or preventing virus (e.g., coronavirus) infection in a subject in need of said treatment or prevention by administering an antibody or antigen-binding fragment of Table 1 in association with a further therapeutic agent are part of the present invention.

For example, in an embodiment of the invention, the further therapeutic agent is a vaccine, e.g., a coronavirus vaccine. In an embodiment of the invention, a vaccine is an inactivated/killed virus vaccine, a live attenuated virus vaccine or a virus subunit vaccine.

For example, in an embodiment of the invention, the further therapeutic agent is:

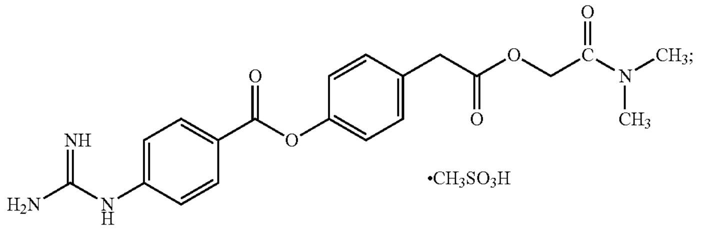

(camostat mesylate)

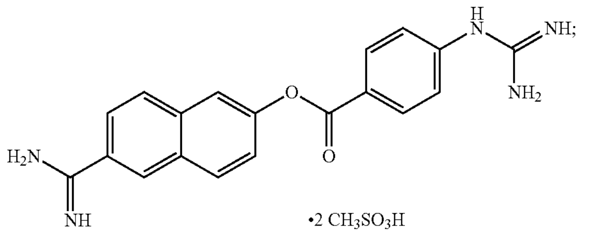

(nafamostat mesylate)

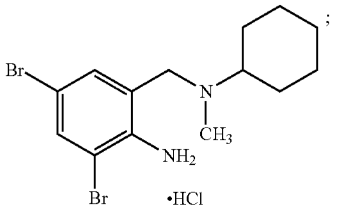

(bromhexine hydrochloride (BHH))

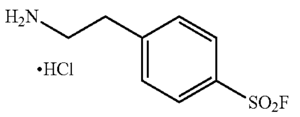

(4-(2-aminomethyl)benzenesulfonyl fluoride hydrochloride (AEBSF));

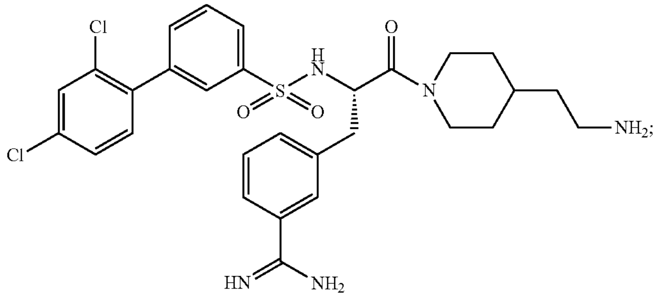

-continued

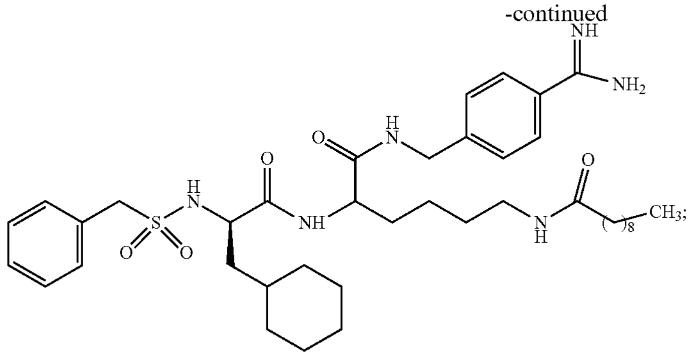

or

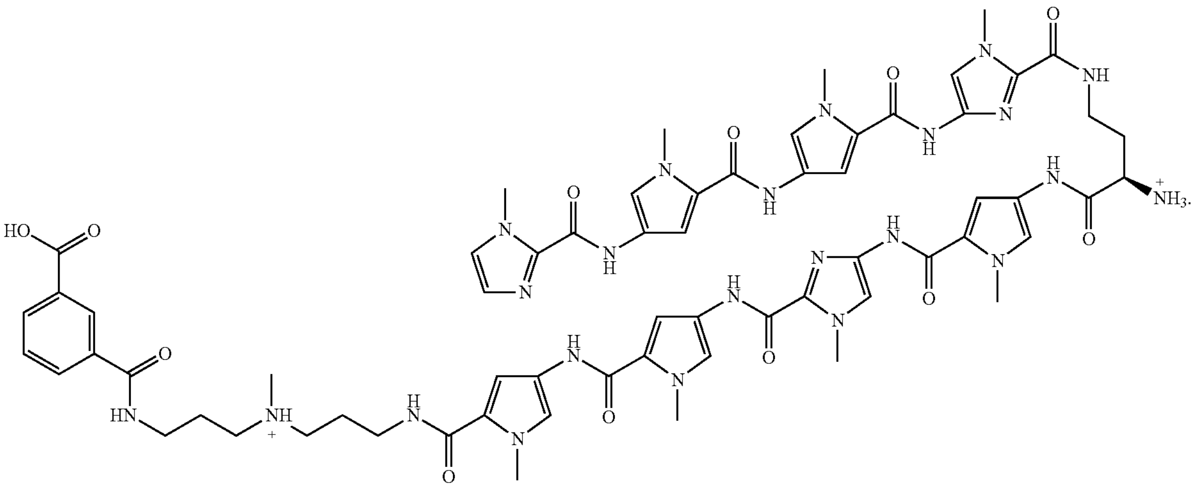

(polyamide). See Shen et al. Biochimie 142: 1-10 (2017)

In an embodiment of the invention, the anti-viral drug is an antibody or antigen-binding fragment that binds specifically to coronavirus, e.g., SARS-CoV-2, SARS-CoV, or MERS-CoV. Exemplary anti-CoV-S antibodies include, but are not limited to: H4sH15188P; H1H15188P; H1H15211P; H1H15177P; H4sH15211P; H1H15260P2; H1H15259P2; H1H15203P; H4sH15260P2; H4sH15231P2; H1H15237P2; H1H15208P; H1H15228P2; H1H15233P2; H1H15264P2; H1H15231P2; H1H15253P2; H1H15215P; and H1H15249P2, as set forth in International patent application publication no. WO/2015/179535, or an antigen-binding fragment thereof, e.g., wherein the antibody or fragment comprises a light chain immunoglobulin that includes CDR-L1, CDR-L2 and CDR-L3 (e.g., the $V_L$ or light chain thereof); and a heavy chain that includes CDR-H1, CDR-H2 and CDR-H3 (e.g., the $V_H$ or heavy chain thereof) of any of the foregoing anti-CoV-S antibodies.

In a certain embodiment of the invention, the further therapeutic agent is not aprotinin, leupeptin, a cationic steroid antimicrobial, an influenza vaccine (e.g., killed, live, attenuated whole virus or subunit vaccine), or an antibody against influenza virus (e.g., an anti-hemagglutinin antibody).

The term "in association with" indicates that the components, an anti-CoV-S antigen-binding protein, e.g., antibody or antigen-binding fragment thereof of the present invention, along with another agent, can be formulated into a single composition, e.g., for simultaneous delivery, or formulated separately into two or more compositions (e.g., a kit). Each component can be administered to a subject at a different time than when the other component is administered; for example, each administration may be given non-simultaneously (e.g., separately or sequentially) at intervals over a given period of time. Moreover, the separate components may be administered to a subject by the same or by a different route (e.g., wherein an anti-CoV-S antibody or antigen-binding fragment thereof.

Kits

Further provided are kits comprising one or more components that include, but are not limited to, an anti-CoV-S antigen-binding protein, e.g., an antibody or antigen-binding fragment as discussed herein (e.g., of Table 1), in association with one or more additional components including, but not limited to, a further therapeutic agent, as discussed herein. The antigen-binding protein and/or the further therapeutic agent can be formulated as a single composition or separately in two or more compositions, e.g., with a pharmaceutically acceptable carrier, in a pharmaceutical composition.

In one embodiment of the invention, the kit includes an anti-CoV-S antigen-binding protein, e.g., an antibody or antigen-binding fragment thereof of the invention (e.g., of Table 1), or a pharmaceutical composition thereof in one container (e.g., in a sterile glass or plastic vial) and a further therapeutic agent in another container (e.g., in a sterile glass or plastic vial).

In another embodiment, the kit comprises a combination of the invention, including an anti-CoV-S antigen-binding protein, e.g., antibody or antigen-binding fragment thereof of the invention (e.g., of Table 1), or pharmaceutical composition thereof in combination with one or more further therapeutic agents formulated together, optionally, in a pharmaceutical composition, in a single, common container.

If the kit includes a pharmaceutical composition for parenteral administration to a subject, the kit can include a device (e.g., an injection device) for performing such administration. For example, the kit can include one or more hypodermic needles or other injection devices as discussed above containing the anti-CoV-S antigen-binding protein, e.g., antibody or antigen-binding fragment thereof of the present invention (e.g., of Table 1).

The kit can include a package insert including information concerning the pharmaceutical compositions and dosage forms in the kit. Generally, such information aids patients and physicians in using the enclosed pharmaceutical compositions and dosage forms effectively and safely. For example, the following information regarding a combination of the invention may be supplied in the insert: pharmacokinetics, pharmacodynamics, clinical studies, efficacy parameters, indications and usage, contraindications, warnings, precautions, adverse reactions, overdosage, proper dosage and administration, how supplied, proper storage conditions, references, manufacturer/distributor information and patent information.

Diagnostic Uses of the Antibodies

The anti-CoV-S antigen-binding proteins, e.g., antibodies or antigen-binding fragments thereof of the present invention (e.g., of Table 1), may be used to detect and/or measure CoV-S in a sample. Exemplary assays for CoV-S may include, e.g., contacting a sample with an anti-CoV-S antigen-binding protein of the invention, wherein the anti-CoV-S antigen-binding protein is labeled with a detectable label or reporter molecule or used as a capture ligand to selectively isolate CoV-S from samples. The presence of an anti-CoV-S antigen-binding protein complexed with CoV-S indicates the presence of CoV-S in the sample. Alternatively, an unlabeled anti-CoV-S antibody can be used in combination with a secondary antibody which is itself detectably labeled. The detectable label or reporter molecule can be a radioisotope, such as $^{3}H$, $^{14}C$, $^{32}P$, $^{35}S$, or $^{125}I$; a fluorescent or chemiluminescent moiety such as fluorescein isothiocyanate, or rhodamine; or an enzyme such as alkaline phosphatase, β-galactosidase, horseradish peroxidase, or luciferase. Specific exemplary assays that can be used to detect or measure CoV-S in a sample include neutralization assays, enzyme-linked immunosorbent assay (ELISA), radioimmunoassay (MA), and fluorescence-activated cell sorting (FACS). Thus, the present invention includes a method for detecting the presence of spike protein polypeptide in a sample comprising contacting the sample with an anti-CoV-S antigen-binding protein and detecting the presence of a CoV-S/anti-CoV-S antigen-binding protein wherein the presence of the complex indicates the presence of CoV-S.

An anti-CoV-S antigen-binding protein of the invention (e.g., of Table 1) may be used in a Western blot or immune-protein blot procedure for detecting the presence of CoV-S or a fragment thereof in a sample. Such a procedure forms part of the present invention and includes the steps of e.g.:

(1) providing a membrane or other solid substrate comprising a sample to be tested for the presence of CoV-S, e.g., optionally including the step of transferring proteins from a sample to be tested for the presence of CoV-S (e.g., from a PAGE or SDS-PAGE electrophoretic separation of the proteins in the sample) onto a membrane or other solid substrate using a method known in the art (e.g., semi-dry blotting or tank blotting); and contacting the membrane or other solid substrate to be tested for the presence of CoV-S or a fragment thereof with an anti-CoV-S antigen-binding protein of the invention.

Such a membrane may take the form, for example, of a nitrocellulose or vinyl-based (e.g., polyvinylidene fluoride (PVDF)) membrane to which the proteins to be tested for the presence of CoV-S in a non-denaturing PAGE (polyacrylamide gel electrophoresis) gel or SDS-PAGE (sodium dodecyl sulfate polyacrylamide gel electrophoresis) gel have been transferred (e.g., following electrophoretic separation in the gel). Before contacting the membrane with the anti-CoV-S antigen-binding protein, the membrane is optionally blocked, e.g., with non-fat dry milk or the like so as to bind non-specific protein binding sites on the membrane.

(2) washing the membrane one or more times to remove unbound anti-CoV-S antigen-binding protein and other unbound substances; and (3) detecting the bound anti-CoV-S antigen-binding protein.

Detection of the bound antigen-binding protein indicates that the CoV-S protein is present on the membrane or substrate and in the sample. Detection of the bound antigen-binding protein may be by binding the antigen-binding protein with a secondary antibody (an anti-immunoglobulin antibody) which is detectably labeled and, then, detecting the presence of the secondary antibody label.

The anti-CoV-S antigen-binding proteins (e.g., antibodies and antigen-binding fragments (e.g., of Table 1)) disclosed herein may also be used for immunohistochemistry. Such a method forms part of the present invention and comprises, e.g., (1) contacting tissue to be tested for the presence of CoV-S protein with an anti-CoV-S antigen-binding protein of the invention; and (2) detecting the antigen-binding protein on or in the tissue.

If the antigen-binding protein itself is detectably labeled, it can be detected directly. Alternatively, the antigen-binding protein may be bound by a detectably labeled secondary antibody wherein the label is then detected.

EXAMPLES

The following examples are put forth so as to provide those of ordinary skill in the art with a complete disclosure and description of how to make and use the methods and compositions of the invention and are not intended to limit the scope of what the inventors regard as their invention. Efforts have been made to ensure accuracy with respect to numbers used (e.g., amounts, temperature, etc.) but some experimental errors and deviations should be accounted for. Unless indicated otherwise, parts are parts by weight, molecular weight is average molecular weight, temperature is in degrees Centigrade, room temperature is about and pressure is at or near atmospheric.

Example 1: Generation of Human Antibodies to SARS-CoV-2 Spike Protein (SARS-CoV-2-S)

Human antibodies to SARS-CoV-2-Spike protein (SARS-CoV-2-S) were generated in a VELOCIMMUNE® mouse comprising DNA encoding human immunoglobulin heavy and kappa light chain variable regions or human immunoglobulin heavy and lambda light chain variable regions. Each mouse was immunized with a vector expressing the SARS-CoV-2-S receptor binding domain (RBD) (amino acids 1-1273 of NCBI accession number (MN908947.3), SEQ ID NO: 832), followed by a booster with a SARS-CoV-2-S vector or a SARS-CoV-2-S protein. The antibody immune response was monitored by a SARS-CoV-2-S-specific immunoassay. When a desired immune response was achieved, lymphocytes were harvested and fused with mouse myeloma cells to preserve their viability and form hybridoma cell lines. The hybridoma cell lines were screened and selected to identify cell lines that produce SARS-CoV-2-S-specific antibodies. Anti-SARS-CoV-2-S antibodies were also isolated directly from antigen-positive mouse B cells without fusion to myeloma cells, as described in U.S. Pat. No. 7,582,298, herein specifically incorporated by reference in its entirety. Using this method, fully human anti-SARS-CoV-2-S antibodies (i.e., antibodies possessing human variable domains and human constant domains) were obtained.

Antibodies were also isolated from human blood samples. Whole blood was received from patients 3-4 weeks after a laboratory-confirmed PCR positive test for SARS-CoV-2 and symptomatic COVID-19 disease. Red blood cells were lysed in ACK lysis buffer (Life Technologies), and peripheral blood mononuclear cells (PBMCs) were isolated by a Ficoll gradient. From the PBMCs, single B cells that bind the SARS-CoV-2 spike protein were isolated by fluorescent-activated cell sorting (FACS). Isolated B cells were single-well plated and mixed with antibody light and heavy variable region-specific PCR primers. cDNAs for each single B cell were synthesized via a reverse transcriptase (RT) reaction. Each resulting RT product was then split and transferred into two corresponding wells for subsequent antibody heavy and light chain PCRs. One set of the resulting RT products was first amplified by PCR using a 5' degenerate primer specific for antibody heavy variable region leader sequence or a 5' degenerate primer specific for antibody light chain variable region leader sequence and a 3' primer specific for antibody constant region, to form an amplicon. The amplicons were then amplified again by PCR using a 5' degenerate primer specific for antibody heavy variable region framework 1 or a degenerate primer specific for antibody light chain variable region framework 1 and a 3' primer specific for antibody constant region, to generate amplicons for cloning. The antibody heavy chain and light chain derived PCR products were cloned into expression vectors containing heavy constant region and light constant region, respectively. The expression vectors expressing full-length heavy and light chain pairs were transfected into CHO cells to produce antibody proteins for testing.

The biological properties of exemplary antibodies generated in accordance with the methods of this Example are described in detail in the Examples set forth below.

Example 2: Heavy and Light Chain Variable Region Amino Acid and Nucleotide Sequences Table 1 sets forth the amino acid sequence identifiers of the heavy and light chain variable regions and CDRs, as well as the heavy chain and light chain sequences, of exemplary anti-SARS-CoV-2-S antibodies. The corresponding nucleic acid sequence identifiers are set forth in Table 2.

TABLE 1

| Amino Acid Sequence Identifiers | | | | | | | | | | |
|---|---|---|---|---|---|---|---|---|---|---|
| | SEQ ID NOs | | | | | | | | | |
| Antibody Designation | HCVR | HCDR 1 | HCDR 2 | HCDR 3 | LCVR | LCDR 1 | LCDR 2 | LCDR 3 | HC | LC |
| mAb10913 | 2 | 4 | 6 | 8 | 10 | 12 | 14 | 16 | 18 | 20 |
| mAb10915 | 22 | 24 | 26 | 28 | 30 | 32 | 34 | 36 | 38 | 40 |
| mAb10916 | 2 | 4 | 6 | 8 | 10 | 12 | 14 | 16 | 42 | 20 |
| mAb10917 | 44 | 46 | 26 | 49 | 51 | 53 | 55 | 57 | 59 | 61 |
| mAb10918 | 22 | 24 | 26 | 28 | 30 | 32 | 34 | 36 | 63 | 40 |
| mAb10920 | 65 | 67 | 69 | 71 | 73 | 75 | 55 | 77 | 79 | 81 |
| mAb10921 | 83 | 85 | 26 | 87 | 89 | 91 | 55 | 93 | 95 | 97 |
| mAb10922 | 99 | 101 | 103 | 105 | 107 | 109 | 111 | 113 | 115 | 117 |
| mAb10923 | 119 | 121 | 123 | 125 | 127 | 129 | 55 | 131 | 133 | 135 |
| mAb10924 | 137 | 139 | 141 | 143 | 145 | 147 | 149 | 151 | 153 | 155 |
| mAb10925 | 65 | 67 | 69 | 71 | 73 | 75 | 55 | 77 | 157 | 81 |
| mAb10926 | 83 | 85 | 26 | 87 | 89 | 91 | 55 | 93 | 159 | 97 |
| mAb10927 | 99 | 101 | 103 | 105 | 107 | 109 | 111 | 113 | 161 | 117 |
| mAb10928 | 119 | 121 | 123 | 125 | 127 | 129 | 55 | 131 | 163 | 135 |
| mAb10929 | 137 | 139 | 141 | 143 | 145 | 147 | 149 | 151 | 165 | 155 |
| mAb10930 | 167 | 169 | 171 | 173 | 175 | 129 | 55 | 177 | 179 | 181 |
| mAb10931 | 167 | 169 | 171 | 173 | 175 | 129 | 55 | 177 | 183 | 181 |
| mAb10932 | 185 | 187 | 26 | 189 | 191 | 75 | 194 | 196 | 198 | 200 |
| mAb10933 | 202 | 204 | 206 | 208 | 210 | 212 | 55 | 214 | 216 | 218 |
| mAb10934 | 220 | 222 | 224 | 226 | 228 | 230 | 194 | 232 | 234 | 236 |
| mAb10935 | 238 | 24 | 26 | 240 | 242 | 244 | 194 | 246 | 248 | 250 |
| mAb10936 | 252 | 254 | 256 | 258 | 260 | 129 | 55 | 262 | 264 | 266 |
| mAb10937 | 268 | 270 | 272 | 274 | 276 | 129 | 55 | 278 | 280 | 282 |
| mAb10940 | 284 | 169 | 286 | 288 | 290 | 292 | 294 | 296 | 298 | 300 |
| mAb10938 | 302 | 24 | 26 | 304 | 306 | 308 | 194 | 310 | 312 | 314 |
| mAb10939 | 316 | 187 | 319 | 321 | 323 | 325 | 55 | 327 | 329 | 331 |
| mAb10941 | 333 | 85 | 26 | 336 | 338 | 340 | 294 | 296 | 342 | 344 |
| mAb10942 | 185 | 187 | 26 | 189 | 191 | 75 | 194 | 196 | 346 | 200 |
| mAb10943 | 202 | 204 | 206 | 208 | 210 | 212 | 55 | 214 | 348 | 218 |
| mAb10944 | 220 | 222 | 224 | 226 | 228 | 230 | 194 | 232 | 350 | 236 |
| mAb10945 | 238 | 24 | 26 | 240 | 242 | 244 | 194 | 246 | 352 | 250 |
| mAb10946 | 252 | 254 | 256 | 258 | 260 | 129 | 55 | 262 | 354 | 266 |
| mAb10947 | 268 | 270 | 272 | 274 | 276 | 129 | 55 | 278 | 356 | 282 |
| mAb10948 | 302 | 24 | 26 | 304 | 306 | 308 | 194 | 310 | 358 | 314 |
| mAb10949 | 316 | 187 | 319 | 321 | 323 | 325 | 55 | 327 | 360 | 331 |

TABLE 1-continued

| Amino Acid Sequence Identifiers | | | | | | | | | | |
|---|---|---|---|---|---|---|---|---|---|---|
| | SEQ ID NOs | | | | | | | | | |
| Antibody Designation | HCVR | HCDR 1 | HCDR 2 | HCDR 3 | LCVR | LCDR 1 | LCDR 2 | LCDR 3 | HC | LC |
| mAb10951 | 333 | 85 | 26 | 336 | 338 | 340 | 294 | 296 | 362 | 344 |
| mAb10950 | 284 | 169 | 286 | 288 | 290 | 292 | 294 | 296 | 364 | 300 |
| mAb10954 | 366 | 85 | 26 | 370 | 372 | 244 | 194 | 375 | 377 | 379 |
| mAb10955 | 381 | 383 | 26 | 385 | 387 | 389 | 194 | 310 | 392 | 394 |
| mAb10956 | 396 | 187 | 26 | 399 | 401 | 389 | 194 | 403 | 405 | 407 |
| mAb10957 | 409 | 411 | 26 | 414 | 416 | 53 | 55 | 418 | 420 | 422 |
| mAb10958 | 366 | 85 | 26 | 370 | 372 | 244 | 194 | 375 | 424 | 379 |
| mAb10959 | 381 | 383 | 26 | 385 | 387 | 389 | 194 | 310 | 426 | 394 |
| mAb10960 | 396 | 187 | 26 | 399 | 401 | 389 | 194 | 403 | 428 | 407 |
| mAb10961 | 409 | 41. | 26 | 414 | 416 | 53 | 55 | 418 | 430 | 422 |
| mAb10964 | 432 | 434 | 436 | 438 | 440 | 442 | 55 | 445 | 447 | 449 |
| mAb10965 | 451 | 453 | 26 | 455 | 457 | 459 | 34 | 462 | 464 | 466 |
| mAb10966 | 468 | 187 | 26 | 470 | 472 | 389 | 194 | 474 | 476 | 478 |
| mAb10967 | 480 | 24 | 483 | 485 | 487 | 389 | 194 | 489 | 491 | 493 |
| mAb10969 | 495 | 497 | 499 | 501 | 503 | 389 | 194 | 214 | 506 | 508 |
| mAb10970 | 510 | 24 | 26 | 512 | 514 | 516 | 194 | 518 | 520 | 522 |
| mAb10971 | 524 | 411 | 26 | 528 | 530 | 532 | 55 | 534 | 536 | 538 |
| mAb10973 | 432 | 434 | 436 | 438 | 440 | 442 | 55 | 445 | 540 | 449 |
| mAb10974 | 451 | 453 | 26 | 455 | 457 | 459 | 34 | 462 | 542 | 466 |
| mAb10975 | 468 | 187 | 26 | 470 | 472 | 389 | 194 | 474 | 544 | 478 |
| mAb10976 | 480 | 24 | 483 | 485 | 487 | 389 | 194 | 489 | 546 | 493 |
| mAb10977 | 548 | 550 | 552 | 554 | 556 | 558 | 294 | 560 | 562 | 564 |
| mAb10978 | 495 | 497 | 499 | 501 | 503 | 389 | 194 | 214 | 566 | 508 |
| mAb10979 | 510 | 24 | 26 | 512 | 514 | 516 | 194 | 518 | 568 | 522 |
| mAb10980 | 524 | 411 | 26 | 528 | 530 | 532 | 55 | 534 | 570 | 538 |
| mAb10981 | 548 | 550 | 552 | 554 | 556 | 558 | 294 | 560 | 572 | 564 |
| mAb10982 | 574 | 187 | 576 | 578 | 580 | 582 | 584 | 586 | 588 | 590 |
| mAb10983 | 574 | 187 | 576 | 578 | 580 | 582 | 584 | 586 | 592 | 590 |
| mAb10984 | 594 | 596 | 26 | 598 | 600 | 12 | 14 | 602 | 604 | 606 |
| mAb10985 | 608 | 169 | 610 | 612 | 614 | 616 | 584 | 618 | 620 | 622 |
| mAb10986 | 624 | 626 | 26 | 628 | 630 | 582 | 632 | 634 | 636 | 638 |
| mAb10987 | 640 | 642 | 499 | 644 | 646 | 648 | 650 | 652 | 654 | 656 |
| mAb10988 | 658 | 660 | 662 | 664 | 666 | 668 | 670 | 672 | 674 | 676 |
| mAb10989 | 678 | 680 | 682 | 684 | 686 | 688 | 650 | 690 | 692 | 694 |
| mAb10990 | 594 | 596 | 26 | 598 | 600 | 12 | 14 | 602 | 696 | 606 |
| mAb10991 | 608 | 169 | 610 | 612 | 614 | 616 | 584 | 618 | 698 | 622 |
| mAb10992 | 624 | 626 | 26 | 628 | 630 | 582 | 632 | 634 | 700 | 638 |
| mAb10993 | 640 | 642 | 499 | 644 | 646 | 648 | 650 | 652 | 702 | 656 |
| mAb10994 | 658 | 660 | 662 | 664 | 666 | 668 | 670 | 672 | 704 | 676 |
| mAb10995 | 678 | 680 | 682 | 684 | 686 | 688 | 650 | 690 | 706 | 694 |
| mAb10996 | 708 | 24 | 26 | 711 | 713 | 129 | 55 | 715 | 717 | 719 |
| mAb10997 | 708 | 24 | 26 | 71. | 713 | 129 | 55 | 715 | 721 | 719 |
| mAb10998 | 723 | 187 | 26 | 725 | 727 | 129 | 55 | 729 | 731 | 733 |
| mAb10999 | 723 | 187 | 26 | 725 | 727 | 129 | 55 | 729 | 735 | 733 |
| mAb11000 | 737 | 24 | 26 | 739 | 741 | 743 | 55 | 745 | 747 | 749 |
| mAb11001 | 737 | 24 | 26 | 739 | 741 | 743 | 55 | 745 | 751 | 749 |
| mAb11002 | 753 | 24 | 26 | 755 | 713 | 129 | 55 | 715 | 757 | 719 |
| mAb11003 | 753 | 24 | 26 | 755 | 713 | 129 | 55 | 715 | 759 | 719 |
| mAb10914 | 44 | 46 | 26 | 49 | 51 | 53 | 55 | 57 | 762 | 61 |
| mAb11004 | 764 | 766 | 499 | 768 | 770 | 91 | 55 | 772 | 774 | 776 |
| mAb11005 | 764 | 766 | 499 | 768 | 770 | 91 | 55 | 772 | 778 | 776 |
| mAb11006 | 780 | 782 | 26 | 784 | 786 | 53 | 55 | 788 | 790 | 792 |
| mAb11007 | 780 | 782 | 26 | 784 | 786 | 53 | 55 | 788 | 794 | 792 |
| mAb11008 | 796 | 24 | 26 | 798 | 800 | 53 | 55 | 802 | 804 | 806 |
| mAb11009 | 796 | 24 | 26 | 798 | 800 | 53 | 55 | 802 | 808 | 806 |
| mAb11010 | 810 | 812 | 814 | 816 | 818 | 129 | 820 | 822 | 824 | 826 |
| mAb11011 | 810 | 812 | 814 | 816 | 818 | 129 | 820 | 822 | 828 | 826 |

TABLE 2

| Nucleic Acid Sequence Identifiers | | | | | | | | | | |
|---|---|---|---|---|---|---|---|---|---|---|
| | SEQ ID NOs | | | | | | | | | |
| Antibody Designation | HCVR | HCDR 1 | HCDR 2 | HCDR 3 | LCVR | LCDR 1 | LCDR 2 | LCDR 3 | HC | LC |
| mAb10913 | 1 | 3 | 5 | 7 | 9 | 11 | 13 | 15 | 17 | 19 |
| mAb10915 | 21 | 23 | 25 | 27 | 29 | 31 | 33 | 35 | 37 | 39 |
| mAb10916 | 1 | 3 | 5 | 7 | 9 | 11 | 13 | 15 | 41 | 19 |

TABLE 2-continued

Nucleic Acid Sequence Identifiers

| Antibody Designation | SEQ ID NOs HCVR | HCDR 1 | HCDR 2 | HCDR 3 | LCVR | LCDR 1 | LCDR 2 | LCDR 3 | HC | LC |
|---|---|---|---|---|---|---|---|---|---|---|
| mAb10917 | 43 | 45 | 47 | 48 | 50 | 52 | 54 | 56 | 58 | 60 |
| mAb10918 | 21 | 23 | 25 | 27 | 29 | 31 | 33 | 35 | 62 | 39 |
| mAb10920 | 64 | 66 | 68 | 70 | 72 | 74 | 54 | 76 | 78 | 80 |
| mAb10921 | 82 | 84 | 47 | 86 | 88 | 90 | 54 | 92 | 94 | 96 |
| mAb10922 | 98 | 100 | 102 | 104 | 106 | 108 | 110 | 112 | 114 | 116 |
| mAb10923 | 118 | 120 | 122 | 124 | 126 | 128 | 54 | 130 | 132 | 134 |
| mAb10924 | 136 | 138 | 140 | 142 | 144 | 146 | 148 | 150 | 152 | 154 |
| mAb10925 | 64 | 66 | 68 | 70 | 72 | 74 | 54 | 76 | 156 | 80 |
| mAb10926 | 82 | 84 | 47 | 86 | 88 | 90 | 54 | 92 | 158 | 96 |
| mAb10927 | 98 | 100 | 102 | 104 | 106 | 108 | 110 | 112 | 160 | 116 |
| mAb10928 | 118 | 120 | 122 | 124 | 126 | 128 | 54 | 130 | 162 | 134 |
| mAb10929 | 136 | 138 | 140 | 142 | 144 | 146 | 148 | 150 | 164 | 154 |
| mAb10930 | 166 | 168 | 170 | 172 | 174 | 128 | 54 | 176 | 178 | 180 |
| mAb10931 | 166 | 168 | 170 | 172 | 174 | 128 | 54 | 176 | 182 | 180 |
| mAb10932 | 184 | 186 | 47 | 188 | 190 | 192 | 193 | 195 | 197 | 199 |
| mAb10933 | 201 | 203 | 205 | 207 | 209 | 211 | 54 | 213 | 215 | 217 |
| mAb10934 | 219 | 221 | 223 | 225 | 227 | 229 | 193 | 231 | 233 | 235 |
| mAb10935 | 237 | 23 | 47 | 239 | 241 | 243 | 193 | 245 | 247 | 249 |
| mAb10936 | 251 | 253 | 255 | 257 | 259 | 128 | 54 | 261 | 263 | 265 |
| mAb10937 | 267 | 269 | 271 | 273 | 275 | 128 | 54 | 277 | 279 | 281 |
| mAb10940 | 283 | 168 | 285 | 287 | 289 | 291 | 293 | 295 | 297 | 299 |
| mAb10938 | 301 | 23 | 47 | 303 | 305 | 307 | 193 | 309 | 311 | 313 |
| mAb10939 | 315 | 317 | 318 | 320 | 322 | 324 | 54 | 326 | 328 | 330 |
| mAb10941 | 332 | 334 | 47 | 335 | 337 | 339 | 293 | 295 | 341 | 343 |
| mAb10942 | 184 | 186 | 47 | 188 | 190 | 192 | 193 | 195 | 345 | 199 |
| mAb10943 | 201 | 203 | 205 | 207 | 209 | 211 | 54 | 213 | 347 | 217 |
| mAb10944 | 219 | 221 | 223 | 225 | 227 | 229 | 193 | 231 | 349 | 235 |
| mAb10945 | 237 | 23 | 47 | 239 | 241 | 243 | 193 | 245 | 351 | 249 |
| mAb10946 | 251 | 253 | 255 | 257 | 259 | 128 | 54 | 261 | 353 | 265 |
| mAb10947 | 267 | 269 | 271 | 273 | 275 | 128 | 54 | 277 | 355 | 281 |
| mAb10948 | 301 | 23 | 47 | 303 | 305 | 307 | 193 | 309 | 357 | 313 |
| mAb10949 | 315 | 317 | 318 | 320 | 322 | 324 | 54 | 326 | 359 | 330 |
| mAb10951 | 332 | 334 | 47 | 335 | 337 | 339 | 293 | 295 | 361 | 343 |
| mAb10950 | 283 | 168 | 285 | 287 | 289 | 291 | 293 | 295 | 363 | 299 |
| mAb10954 | 365 | 367 | 368 | 369 | 371 | 373 | 193 | 374 | 376 | 378 |
| mAb10955 | 380 | 382 | 47 | 384 | 386 | 388 | 193 | 390 | 391 | 393 |
| mAb10956 | 395 | 397 | 47 | 398 | 400 | 388 | 193 | 402 | 404 | 406 |
| mAb10957 | 408 | 410 | 412 | 413 | 415 | 52 | 54 | 417 | 419 | 421 |
| mAb10958 | 365 | 367 | 368 | 369 | 371 | 373 | 193 | 374 | 423 | 378 |
| mAb10959 | 380 | 382 | 47 | 384 | 386 | 388 | 193 | 390 | 425 | 393 |
| mAb10960 | 395 | 397 | 47 | 398 | 400 | 388 | 193 | 402 | 427 | 406 |
| mAb10961 | 408 | 410 | 412 | 413 | 415 | 52 | 54 | 417 | 429 | 421 |
| mAb10964 | 431 | 433 | 435 | 437 | 439 | 441 | 443 | 444 | 446 | 448 |
| mAb10965 | 450 | 452 | 47 | 454 | 456 | 458 | 460 | 461 | 463 | 465 |
| mAb10966 | 467 | 397 | 412 | 469 | 471 | 388 | 193 | 473 | 475 | 477 |
| mAb10967 | 479 | 481 | 482 | 484 | 486 | 388 | 193 | 488 | 490 | 492 |
| mAb10969 | 494 | 496 | 498 | 500 | 502 | 388 | 193 | 504 | 505 | 507 |
| mAb10970 | 509 | 481 | 412 | 511 | 513 | 515 | 193 | 517 | 519 | 521 |
| mAb10971 | 523 | 525 | 526 | 527 | 529 | 531 | 54 | 533 | 535 | 537 |
| mAb10973 | 431 | 433 | 435 | 437 | 439 | 441 | 443 | 444 | 539 | 448 |
| mAb10974 | 450 | 452 | 47 | 454 | 456 | 458 | 460 | 461 | 541 | 465 |
| mAb10975 | 467 | 397 | 412 | 469 | 471 | 388 | 193 | 473 | 543 | 477 |
| mAb10976 | 479 | 481 | 482 | 484 | 486 | 388 | 193 | 488 | 545 | 492 |
| mAb10977 | 547 | 549 | 551 | 553 | 555 | 557 | 293 | 559 | 561 | 563 |
| mAb10978 | 494 | 496 | 498 | 500 | 502 | 388 | 193 | 504 | 565 | 507 |
| mAb10979 | 509 | 481 | 412 | 511 | 513 | 515 | 193 | 517 | 567 | 521 |
| mAb10980 | 523 | 525 | 526 | 527 | 529 | 531 | 54 | 533 | 569 | 537 |
| mAb10981 | 547 | 549 | 551 | 553 | 555 | 557 | 293 | 559 | 571 | 563 |
| mAb10982 | 573 | 186 | 575 | 577 | 579 | 581 | 583 | 585 | 587 | 589 |
| mAb10983 | 573 | 186 | 575 | 577 | 579 | 581 | 583 | 585 | 591 | 589 |
| mAb10984 | 593 | 595 | 47 | 597 | 599 | 11 | 13 | 601 | 603 | 605 |
| mAb10985 | 607 | 168 | 609 | 611 | 613 | 615 | 583 | 617 | 619 | 621 |
| mAb10986 | 623 | 625 | 47 | 627 | 629 | 581 | 631 | 633 | 635 | 637 |
| mAb10987 | 639 | 641 | 498 | 643 | 645 | 647 | 649 | 651 | 653 | 655 |
| mAb10988 | 657 | 659 | 661 | 663 | 665 | 667 | 669 | 671 | 673 | 675 |
| mAb10989 | 677 | 679 | 681 | 683 | 685 | 687 | 649 | 689 | 691 | 693 |
| mAb10990 | 593 | 595 | 47 | 597 | 599 | 11 | 13 | 601 | 695 | 605 |
| mAb10991 | 607 | 168 | 609 | 611 | 613 | 615 | 583 | 617 | 697 | 621 |
| mAb10992 | 623 | 625 | 47 | 627 | 629 | 581 | 631 | 633 | 699 | 637 |
| mAb10993 | 639 | 641 | 498 | 643 | 645 | 647 | 649 | 651 | 701 | 655 |
| mAb10994 | 657 | 659 | 661 | 663 | 665 | 667 | 669 | 671 | 703 | 675 |
| mAb10995 | 677 | 679 | 681 | 683 | 685 | 687 | 649 | 689 | 705 | 693 |
| mAb10996 | 707 | 709 | 47 | 710 | 712 | 128 | 54 | 714 | 716 | 718 |

TABLE 2-continued

Nucleic Acid Sequence Identifiers

| Antibody Designation | SEQ ID NOs | | | | | | | | | |
|---|---|---|---|---|---|---|---|---|---|---|
| | HCVR | HCDR 1 | HCDR 2 | HCDR 3 | LCVR | LCDR 1 | LCDR 2 | LCDR 3 | HC | LC |
| mAb10997 | 707 | 709 | 47 | 710 | 712 | 128 | 54 | 714 | 720 | 718 |
| mAb10998 | 722 | 186 | 47 | 724 | 726 | 128 | 54 | 728 | 730 | 732 |
| mAb10999 | 722 | 186 | 47 | 724 | 726 | 128 | 54 | 728 | 734 | 732 |
| mAb11000 | 736 | 23 | 47 | 738 | 740 | 742 | 54 | 744 | 746 | 748 |
| mAb11001 | 736 | 23 | 47 | 738 | 740 | 742 | 54 | 744 | 750 | 748 |
| mAb11002 | 752 | 23 | 47 | 754 | 712 | 128 | 54 | 714 | 756 | 718 |
| mAb11003 | 752 | 23 | 47 | 754 | 712 | 128 | 54 | 714 | 758 | 718 |
| mAb10914 | 760 | 45 | 47 | 48 | 50 | 52 | 54 | 56 | 761 | 60 |
| mAb11004 | 763 | 765 | 498 | 767 | 769 | 90 | 54 | 771 | 773 | 775 |
| mAb11005 | 763 | 765 | 498 | 767 | 769 | 90 | 54 | 771 | 777 | 775 |
| mAb11006 | 779 | 781 | 47 | 783 | 785 | 52 | 54 | 787 | 789 | 791 |
| mAb11007 | 779 | 781 | 47 | 783 | 785 | 52 | 54 | 787 | 793 | 791 |
| mAb11008 | 795 | 709 | 47 | 797 | 799 | 52 | 54 | 801 | 803 | 805 |
| mAb11009 | 795 | 709 | 47 | 797 | 799 | 52 | 54 | 801 | 807 | 805 |
| mAb11010 | 809 | 811 | 813 | 815 | 817 | 128 | 819 | 821 | 823 | 825 |
| mAb11011 | 809 | 811 | 813 | 815 | 817 | 128 | 819 | 821 | 827 | 825 |

Antibodies disclosed herein have fully human variable regions but can have mouse constant regions (e.g., a mouse IgG1 Fc or a mouse IgG2 Fc (a or b isotype)) or human constant regions (e.g., a human IgG1 Fc or a human IgG4 Fc). As will be appreciated by a person of ordinary skill in the art, an antibody having a particular Fc isotype can be converted to an antibody with a different Fc isotype (e.g., an antibody with a mouse IgG1 Fc can be converted to an antibody with a human IgG4, etc.), but in any event, the variable domains (including the CDRs)—which are indicated by the numerical identifiers shown in Tables 1 and 2 will remain the same, and the binding properties to antigen are expected to be identical or substantially similar regardless of the nature of the constant domain.

Figure 10A:
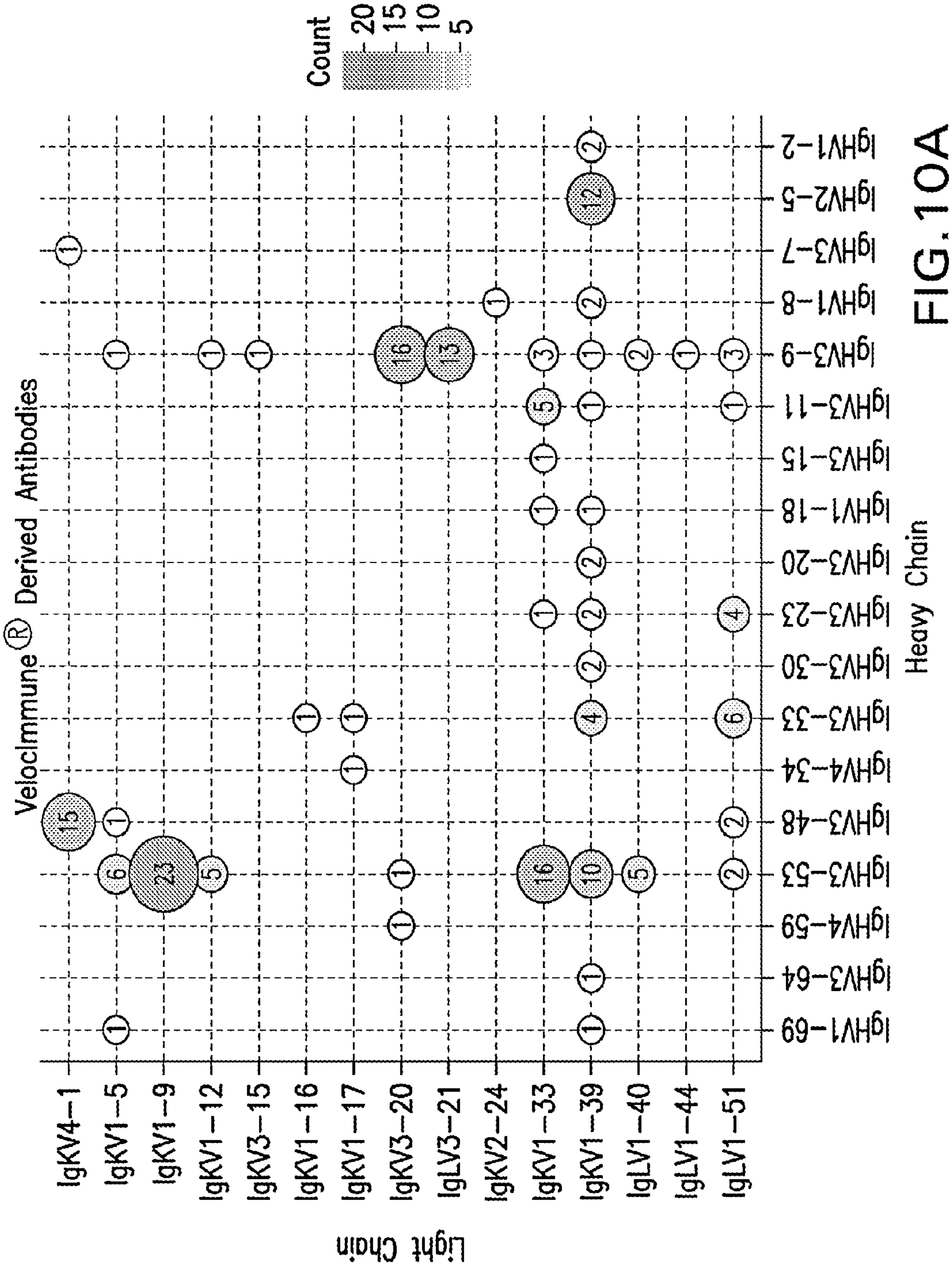
FIG. 10A and FIG. 10B display V gene frequencies for paired Heavy (X-axis) and Light (Y-axis) chains of isolated neutralizing antibodies to SARS-CoV-2 for VelocImmune® mice (FIG. 10A; N=185) and convalescent human donors (FIG. 10B; N=68). The size of the circle corresponds to the number of Heavy and Light chain pairs present in the repertoires of isolated neutralizing antibodies. Neutralization is defined as >70% with 1:4 dilution of antibody (~2 μg/ml) in VSV pseudoparticle neutralization assay.
Figure 10B:
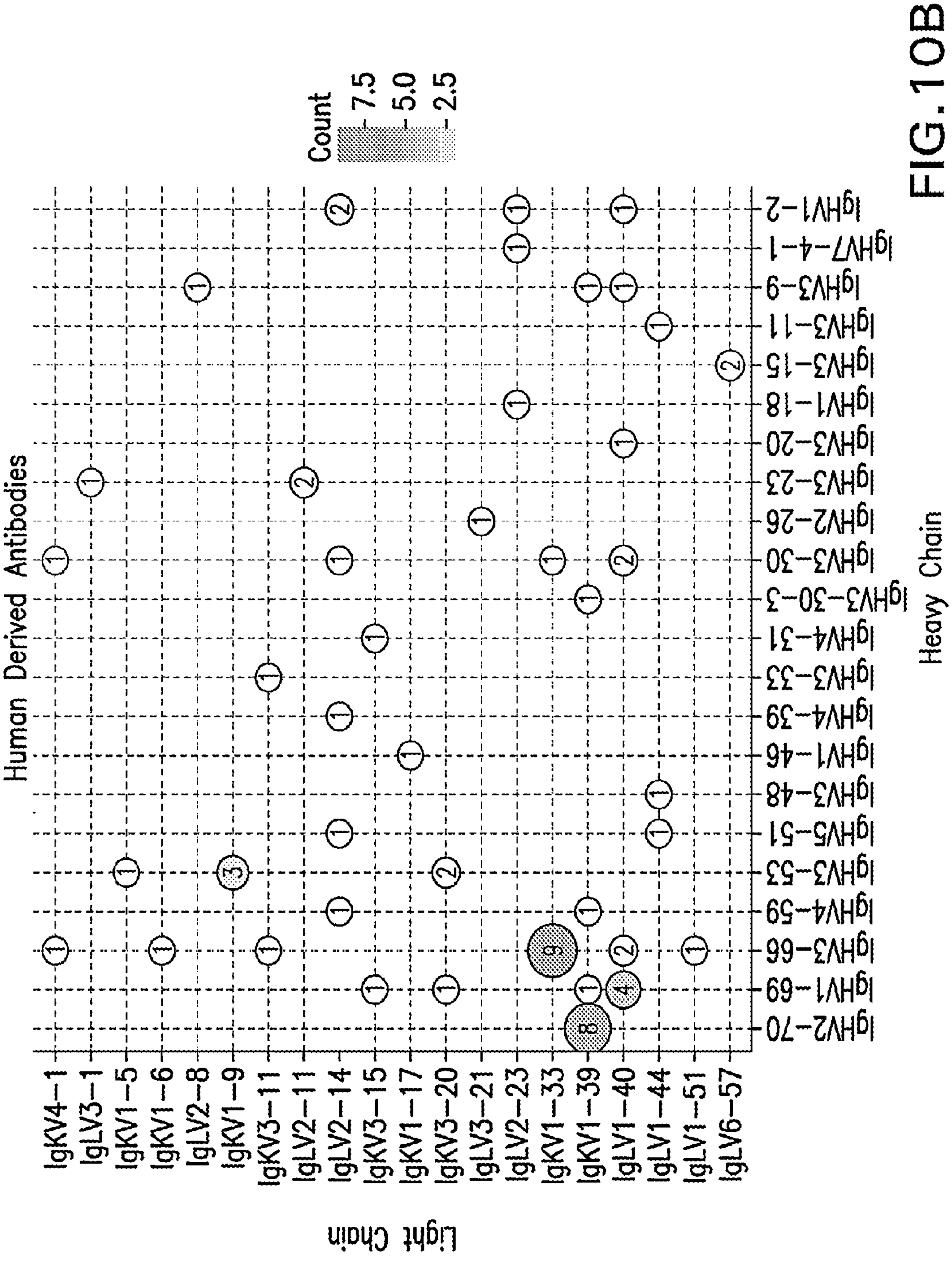

The variable regions of antibodies derived from VELOCIMMUNE® mice and from human samples were sequenced by Next Generation Sequencing and the repertoire for heavy and light chain pairs was identified (FIG. 10A and FIG. 10B). The predominant lineage of VI antibodies utilized VH3-53 paired with VK1-9, VK1-33, or VK1-39 while human-derived antibodies utilized VH3-66 paired with VK1-33 or VH2-70 paired with VK1-39. Further analysis of overlaid sequences showed strong overlap in the repertoire of isolated kappa chains between VI and human-derived antibodies. Although the repertoire of Lambda chains did not overlap well, that may be due to only two lambda mice being included in this trial. The average CDR length for heavy chain was similar between VI and human derived antibodies with an average length of 13 and 14.5 amino acids, respectively. Average kappa CDR length was the same for VI and human derived antibodies at 9 amino acids and was close for lambda chains with an average length of 11.1 and 10.6 amino acids, respectively. Availability of humanized mouse and human-derived antibodies allowed for more diversity of V genes and enabled the later identification of noncompeting antibodies.

As described above, the antibodies were obtained from hybridomas generated from VELOCIMMUNE® mice, by direct isolation from antigen-positive VELOCIMMUNE® mouse B cells, or by direct isolation from antigen-positive human B cells. A summary of these sources is shown in Table 3.

TABLE 3

Antibody sources

| Antibody | Isolation |
|---|---|
| mAb10913 | mouse B cells |
| mAb10915 | mouse B cells |
| mAb10916 | mouse B cells |
| mAb10917 | mouse B cells |
| mAb10918 | mouse B cells |
| mAb10920 | mouse B cells |
| mAb10921 | mouse B cells |
| mAb10922 | mouse B cells |
| mAb10923 | mouse B cells |
| mAb10924 | mouse B cells |
| mAb10925 | mouse B cells |
| mAb10926 | mouse B cells |
| mAb10927 | mouse B cells |
| mAb10928 | mouse B cells |
| mAb10929 | mouse B cells |
| mAb10930 | mouse B cells |
| mAb10931 | mouse B cells |
| mAb10932 | mouse B cells |
| mAb10933 | mouse B cells |
| mAb10934 | mouse B cells |
| mAb10935 | mouse B cells |
| mAb10936 | mouse B cells |
| mAb10937 | mouse B cells |
| mAb10940 | mouse B cells |
| mAb10938 | mouse B cells |
| mAb10939 | mouse B cells |
| mAb10941 | mouse B cells |
| mAb10942 | mouse B cells |
| mAb10943 | mouse B cells |
| mAb10944 | mouse B cells |
| mAb10945 | mouse B cells |
| mAb10946 | mouse B cells |
| mAb10947 | mouse B cells |
| mAb10948 | mouse B cells |
| mAb10949 | mouse B cells |
| mAb10951 | mouse B cells |
| mAb10950 | mouse B cells |
| mAb10954 | human B cells |
| mAb10955 | human B cells |
| mAb10956 | human B cells |
| mAb10957 | human B cells |
| mAb10958 | human B cells |
| mAb10959 | human B cells |
| mAb10960 | human B cells |
| mAb10961 | human B cells |
| mAb10964 | human B cells |
| mAb10965 | human B cells |

TABLE 3-continued

| Antibody sources | |
|---|---|
| Antibody | Isolation |
| mAb10966 | human B cells |
| mAb10967 | human B cells |
| mAb10969 | human B cells |
| mAb10970 | human B cells |
| mAb10971 | human B cells |
| mAb10973 | human B cells |
| mAb10974 | human B cells |
| mAb10975 | human B cells |
| mAb10976 | human B cells |
| mAb10977 | human B cells |
| mAb10978 | human B cells |
| mAb10979 | human B cells |
| mAb10980 | human B cells |
| mAb10981 | human B cells |
| mAb10982 | mouse B cells |
| mAb10983 | mouse B cells |
| mAb10984 | human B cells |
| mAb10985 | human B cells |
| mAb10986 | human B cells |
| mAb10987 | human B cells |
| mAb10988 | human B cells |
| mAb10989 | human B cells |
| mAb10990 | human B cells |
| mAb10991 | human B cells |
| mAb10992 | human B cells |
| mAb10993 | human B cells |
| mAb10994 | human B cells |
| mAb10995 | human B cells |
| mAb10996 | hybridoma |
| mAb10997 | hybridoma |
| mAb10998 | hybridoma |
| mAb10999 | hybridoma |
| mAb11000 | hybridoma |
| mAb11001 | hybridoma |
| mAb11002 | hybridoma |
| mAb11003 | hybridoma |
| mAb10914 | mouse B cells |
| mAb11004 | hybridoma |
| mAb11005 | hybridoma |
| mAb11006 | hybridoma |
| mAb11007 | hybridoma |
| mAb11008 | hybridoma |
| mAb11009 | hybridoma |
| mAb11010 | hybridoma |
| mAb11011 | hybridoma |

Example 3: Characterization of Hybridoma Supernatants by Binding ELISA

An ELISA binding assay was performed to identify antibody supernatants that bound to the SARS-CoV-2-Spike protein receptor binding domain (RBD). A protein composed of the RBD of SARS-CoV-2 (amino acids 319-541) expressed with a 6× histidine tag and two myc epitope tags at the C-terminus (SARS-CoV-2-S-RBD-mmH; see also NCBI Accession Number MN908947.3) was coated at 1 μg/ml on a 96-well plate in PBS buffer overnight at 4° C. Nonspecific binding sites were subsequently blocked using a 0.5% (w/v) solution of BSA in PBS. Antibody supernatants or media alone were diluted 1:40 or 1:50 in the PSA+0.5% BSA blocking buffer and transferred to the washed microtiter plates. After one hour of incubation at room temperature, the wells were washed, and plate-bound supernatant was detected with either goat-anti-human IgG antibody conjugated with horseradish peroxidase (HRP) (Jackson Immunoresearch), or anti-mouse IgG antibody conjugated with horseradish peroxidase (HRP) (Jackson Immunoresearch). The plates were then developed using TMB substrate solution (BD Biosciences) according to manufacturer's recommendation and absorbance at 450 nm was measured on a Victor X5 plate reader.

The ability of anti-SARS-CoV-2-S antibodies to bind the receptor binding domain of SARS-CoV-2-S(SARS-CoV-2-S-RBD) was assessed, as described above, using a binding ELISA with the SARS-CoV-2-S-RBD-mmH protein coated on a microplate. Single point antibody supernatant binding to SARS-CoV-2-S-RBD-mmH coated on 96-well microtiter plates was detected with an HRP conjugated anti-hFc or anti-mFc antibody.

The binding results of three trials are summarized in Table 4. The SARS-CoV-2 binding signals (absorbance 450 nm) are indicated, with the media only background provided as a negative reference per experiment. A sample marked IC (Inconclusive) had an experimental anomaly to the plate and is therefore reported without a value. As shown in comparison to the media only control, the supernatants tested showed substantial binding to the SARS-CoV-2-S-RBD.

TABLE 4

Supernatant binding to SARS-COV-2 spike protein receptor binding domain

| Supernatant | Supernatant Dilution | Detection Antibody | Binding Signal (absorbance at 450 nm) |
|---|---|---|---|
| mAb10913 | 1:50 | a-hFc | 2.752 |
| mAb10914 | 1:50 | a-hFc | 2.857 |
| mAb10915 | 1:50 | a-hFc | 2.76 |
| mAb10932 | 1:50 | a-hFc | 2.718 |
| mAb10933 | 1:50 | a-hFc | 2.762 |
| mAb10934 | 1:50 | a-hFc | 2.688 |
| mAb10935 | 1:50 | a-hFc | 2.676 |
| mAb10936 | 1:50 | a-hFc | 2.644 |
| mAb10937 | 1:50 | a-hFc | 2.664 |
| mAb10920 | 1:50 | a-hFc | 2.683 |
| mAb10921 | 1:50 | a-hFc | 2.633 |
| mAb10922 | 1:50 | a-hFc | 2.595 |
| mAb10923 | 1:50 | a-hFc | 2.353 |
| mAb10924 | 1:50 | a-hFc | 2.269 |
| mAb10930 | 1:50 | a-hFc | 2.451 |
| mAb10938 | 1:50 | a-hFc | 2.536 |
| mAb10939 | 1:50 | a-hFc | 2.516 |
| mAb10940 | 1:50 | a-hFc | 2.77 |
| mAb10941 | 1:50 | a-hFc | IC |
| mAb10982 | 1:50 | a-hFc | 2.537 |
| mAb10984 | 1:50 | a-hFc | 0.716 |
| mAb10985 | 1:50 | a-hFc | 2.35 |
| mAb10986 | 1:50 | a-hFc | 2.331 |
| mAb10987 | 1:50 | a-hFc | 2.438 |
| mAb10988 | 1:50 | a-hFc | 3.062 |
| mAb10989 | 1:50 | a-hFc | 3.116 |
| mAb10969 | 1:50 | a-hFc | 2.629 |
| mAb10970 | 1:50 | a-hFc | 2.807 |
| mAb10971 | 1:50 | a-hFc | 3.052 |
| mAb10964 | 1:50 | a-hFc | 3.086 |
| mAb10965 | 1:50 | a-hFc | 2.918 |
| mAb10966 | 1:50 | a-hFc | 0.421 |
| mAb10967 | 1:50 | a-hFc | 1.732 |
| mAb10954 | 1:50 | a-hFc | 1.963 |
| mAb10955 | 1:50 | a-hFc | 2.469 |
| mAb10956 | 1:50 | a-hFc | 2.6 |
| mAb10957 | 1:50 | a-hFc | 2.49 |
| mAb10977 | 1:50 | a-hFc | 2.925 |
| mAb11010 | 1:40 | a-mFc | 2.896 |
| mAb11004 | 1:40 | a-mFc | 2.908 |
| mAb11000 | 1:40 | a-mFc | 2.725 |
| mAb11006 | 1:40 | a-mFc | 2.619 |
| mAb11008 | 1:40 | a-mFc | 2.907 |
| mAb10998 | 1:40 | a-mFc | 2.835 |
| mAb10996 | 1:40 | a-mFc | 2.826 |

TABLE 4-continued

| Supernatant binding to SARS-COV-2 spike protein receptor binding domain | | | |
|---|---|---|---|
| Supernatant | Supernatant Dilution | Detection Antibody | Binding Signal (absorbance at 450 nm) |
| mAb11002 | 1:40 | a-mFc | 2.581 |
| Media only | 1:50 | a-hFc | 0.069 |
| Media only | 1:40 | a-mFc | 0.058 |
| Media only | 1:50 | a-hFc | 0.055 |

Example 4: Antibody Binding to SARS-CoV-2-S-Expressing Virus-Like Particle

To investigate the ability of a panel of anti-SARS-CoV-2-S monoclonal antibodies to bind the SARS-CoV-2 spike glycoprotein, an in vitro binding assay utilizing SARS-CoV-2 spike protein-expressing viral-like particles (VLPs) in an electrochemiluminescence based detection platform (MSD) was developed.

To transiently express the SARS-CoV-2 spike protein (NCBI Accession number MN908947.3, amino acids 16-1211; SEQ ID NO: 833), Vesicular stomatitis virus (VSV) lacking glycoprotein G (VSV delta G) was pseudotyped with SARS-CoV-2 spike protein (VSV-SARS-CoV-2-S) and generated in HEK293T cells. As a negative binding control, VSV delta G was pseudotyped with VSV G protein (VSV-G).

Experiments were carried out according to following procedure. The two types of VLPs described above were diluted in PBS, seeded into 96-well carbon electrode plates (MULTI-ARRAY high bind plate, MSD), and incubated overnight at 4° C. to allow the VLPs to adhere. Nonspecific binding sites were blocked by 2% BSA (w/v) in PBS for 1 hour at room temperature. Supernatants containing antibodies produced from SARS CoV-2-immunized mice or infected human sera, along with media-only controls which were diluted 1:10 or 1:20 in 1× PBS+0.5% BSA buffer, were added to the plate-bound particles. The plates were then incubated for 1 hour at room temperature with shaking, after which the plates were washed with 1×PBS to remove the unbound antibodies using an AquaMax2000 plate washer (MDS Analytical Technologies). The plate-bound antibodies were detected with a SULFO-TAG™-conjugated anti-human IgG antibody (Jackson Immunoresearch) or a SULFO-TAG™-conjugated anti-mouse IgG antibody (Jackson Immunoresearch) for 1 hour at room temperature. After washes, the plates were developed with the Read Buffer (MSD) according to manufacturer's recommended procedure and the luminescent signals were recorded with a SECTOR Imager 600 (Meso Scale Development) instrument. Direct binding signals (in RLU) were captured, and a ratio of SARS-CoV-2-S-expressing VLPs to the irrelevant VLP was calculated.

The ability of the anti-SARS-CoV-2-S monoclonal antibodies to bind to SARS-CoV-2-S-expressing VLPs compared with binding to irrelevant VSV-expressing VLPs was assessed using an immunobinding assay, as described above. Single-point binding to the immobilized VLPs on 96-well High Bind plates (MSD) was performed with an antibody supernatant dilution of 1:10 or 1:20, bound for 1 hour, and detected using SULFO-TAG™-conjugated anti-human IgG or anti-mouse IgG antibody. The binding signals from electrochemiluminescence were recorded on a Sector Imager 600 (MSD). RLU values were determined for the antibody binding to VLPs. Ratios were calculated comparing the SARS-CoV-2-S-expressing VLP binding signals to control VLPs.

The binding results from three experiments are summarized in Table 5. A signal observed from SARS-CoV-2-S-expressing VLPs indicates binding, while comparison with negative VLPs provides a relative background. Media alone samples provide baseline signals of secondary antibody binding to samples with no supernatant. The 46 antibodies bound specifically at >4-fold higher than the media-only samples (20-35 RLU) on the SARS-CoV-2-S-expressing VLPs, with a range of binding signals from 85-13,600 RLU. The ratios of SARS-CoV-2-S-expressing VSV: VSV-VLPs (negative control) ranged from 1.1-22.7, with many having high background on VSV-VLPs. The ratio of mAb11002 of 0.9 is likely due to a low concentration of monoclonal antibody in the supernatant sample.

TABLE 5

| SARS-COV-2-S VLP binding | | | | | |
|---|---|---|---|---|---|
| Supernatant | Supernatant Dilution | Secondary Detection Antibody | VSV-VLP Binding Signal (RLU) | VSV-SARS-CoV-2-S VLP Binding Signal (RLU) | Ratio of Binding Signals: VSV-SARS-COV-2-S/VSV-VLP |
| mAb10913 | 1:10 | a-hFc | 2155 | 3244 | 1.5 |
| mAb10914 | 1:10 | a-hFc | 3885 | 5181 | 1.3 |
| mAb10915 | 1:10 | a-hFc | 980 | 9022 | 9.2 |
| mAb10932 | 1:10 | a-hFc | 989 | 10451 | 10.6 |
| mAb10933 | 1:10 | a-hFc | 507 | 966 | 1.9 |
| mAb10934 | 1:10 | a-hFc | 3876 | 5041 | 1.3 |
| mAb10935 | 1:10 | a-hFc | 2087 | 3867 | 1.9 |
| mAb10936 | 1:10 | a-hFc | 2325 | 8076 | 3.5 |
| mAb10937 | 1:10 | a-hFc | 1404 | 1920 | 1.4 |
| mAb10920 | 1:10 | a-hFc | 8366 | 10041 | 1.2 |
| mAb10921 | 1:10 | a-hFc | 1194 | 5436 | 4.6 |
| mAb10922 | 1:10 | a-hFc | 1473 | 2229 | 1.5 |
| mAb10923 | 1:10 | a-hFc | 1224 | 1859 | 1.5 |
| mAb10924 | 1:10 | a-hFc | 487 | 969 | 2 |
| mAb10930 | 1:10 | a-hFc | 1769 | 3207 | 1.8 |
| mAb10938 | 1:10 | a-hFc | 1232 | 6623 | 5.4 |
| mAb10939 | 1:10 | a-hFc | 1777 | 5074 | 2.9 |
| mAb10940 | 1:10 | a-hFc | 606 | 2072 | 3.4 |
| mAb10941 | 1:10 | a-hFc | 673 | 4588 | 6.8 |
| mAb10982 | 1:10 | a-hFc | 1178 | 2016 | 1.7 |
| mAb10984 | 1:10 | a-hFc | 2486 | 8989 | 3.6 |
| mAb10985 | 1:10 | a-hFc | 2049 | 3279 | 1.6 |
| mAb10986 | 1:10 | a-hFc | 2044 | 10831 | 5.3 |
| mAb10987 | 1:10 | a-hFc | 1839 | 2450 | 1.3 |
| mAb10988 | 1:10 | a-hFc | 1832 | 2305 | 1.3 |
| mAb10989 | 1:10 | a-hFc | 672 | 1999 | 3 |
| mAb10969 | 1:10 | a-hFc | 3096 | 3313 | 1.1 |
| mAb10970 | 1:10 | a-hFc | 1364 | 5712 | 4.2 |
| mAb10971 | 1:10 | a-hFc | 1135 | 7266 | 6.4 |
| mAb10964 | 1:10 | a-hFc | 1439 | 8601 | 6 |
| mAb10965 | 1:10 | a-hFc | 743 | 1370 | 1.8 |
| mAb10966 | 1:10 | a-hFc | 1428 | 6574 | 4.6 |
| mAb10967 | 1:10 | a-hFc | 1446 | 9510 | 6.6 |
| mAb10954 | 1:10 | a-hFc | 641 | 6308 | 9.8 |
| mAb10955 | 1:10 | a-hFc | 932 | 1788 | 1.9 |
| mAb10956 | 1:10 | a-hFc | 1030 | 1581 | 1.5 |
| mAb10957 | 1:10 | a-hFc | 604 | 5544 | 9.2 |
| mAb10977 | 1:10 | a-hFc | 4141 | 13600 | 3.3 |
| mAb11010 | 1:20 | a-mFc | 96 | 363 | 3.8 |
| mAb11004 | 1:20 | a-mFc | 110 | 406 | 3.7 |
| mAb11000 | 1:20 | a-mFc | 333 | 592 | 1.8 |
| mAb11006 | 1:20 | a-mFc | 165 | 3747 | 22.7 |
| mAb11008 | 1:20 | a-mFc | 103 | 324 | 3.1 |
| mAb10998 | 1:20 | a-mFc | 74 | 218 | 2.9 |
| mAb10996 | 1:20 | a-mFc | 51 | 85 | 1.7 |
| mAb11002 | 1:20 | a-mFc | 156 | 146 | 0.9 |

TABLE 5-continued

| SARS-COV-2-S VLP binding | | | | | |
|---|---|---|---|---|---|
| Supernatant | Supernatant Dilution | Secondary Detection Antibody | VSV-VLP Binding Signal (RLU) | VSV-SARS-CoV-2-S VLP Binding Signal (RLU) | Ratio of Binding Signals: VSV-SARS-COV-2-S/VSV-VLP |
| Media only | 1:10 | a-hFc | 30 | 35 | 1.2 |
| Media only | 1:20 | a-mFc | 35 | 20 | 0.6 |
| Media only | 1:10 | a-hFc | 39 | 29 | 0.7 |

Example 5: Antibody Neutralization of VSV-SARS-CoV-2-S Pseudovirus Infectivity To investigate the ability of a panel of anti-SARS-CoV-2-S monoclonal antibodies to neutralize SARS-CoV-2, an in vitro neutralization assay utilizing VSV-SARS-CoV-2-S pseudovirus was developed.

As described above, VSV pseudotype viruses were generated by transiently transfecting 293T cells with a plasmid encoding for SARS-CoV-2 spike protein. Cells were seeded in 15 cm plates at $1.2 \times 10^7$ cells per plate in DMEM complete media one day prior to transfection with 15 μg/plate spike protein DNA using 125 μL Lipofectamine LTX, 30 μL PLUS reagent, and up to 3 mL Opti-Mem. 24 hours post transfection, the cells were washed with 10 mL PBS, then infected with an MOI of 0.1 $VSV^{\Delta G:mNeon}$ virus in 10 mL Opti-Mem. Virus was incubated on cells for 1 hour, with gentle rocking every 10 minutes. Cells were washed 3 times with 10 mL PBS, then overlaid with 20 mL Infection media before incubation at 37 C, 5% $CO_2$ for 24 hours. Supernatant was collected into 250 mL centrifuge tubes on ice, then centrifuged at 3000 rpm for 5 minutes to pellet any cellular debris, aliquoted on ice, then frozen to −80° C. Infectivity was tested on Vero cells prior to use in neutralization assays. This material will be referred to as VSV-SARS-CoV-2-S.

Neutralization Assay with VSV-SARS-CoV-2-S

On day 1, Vero cells were seeded at 80% confluency in T225 flasks. To seed cells, media was removed from the cells, the cells were washed with 20 mL PBS (Gibco: 20012-043), and 5 mL TrypLE was added and incubated for ~5 minutes at 37° C. until the cells dislodged. 5 mL of complete DMEM was added to inactivate the trypsin, and pipetted up and down to distribute the cells. To count the resuspended cells, 20,000 Vero cells were plated in 100 prewarmed Complete DMEM per well in a 96 Well Black Polystyrene Microplate (Corning: 3904).

On day 2, VSV-SARS-CoV-2-S was thawed on ice and diluted 1:1 with infection media.

In a V-bottom 96 well plate, a dilution of each supernatant was generated in 60 ul infection media. For media (negative) controls, 60 μl of diluted conditioned media was added to the wells. 60 μL of diluted VSV-SARS-CoV-2-S were added to every well except the media control wells. To those wells, 60 μL of infection media was added. Pseudoviruses were then incubated with supernatant dilutions for 30 minutes at room temperature. Media was removed from the Vero cell plates, 100 μL of supernatant/pseudovirus mixtures were transferred to the cells, and the plate was incubated at 37° C., 5% $CO_2$ for 24 hours. The final supernatant dilutions of 1:4 and 1:20, and for some samples 1:100, were used to assess neutralization of VSV-SARS-CoV-2-S pseudoviruses.

On day 3, after the 24 hr incubation, supernatant was removed from the cell wells and replaced with 100 μL of PBS. The plates were then read on a SpectraMax i3 with MiniMax imaging cytometer.

The ability of the anti-SARS-CoV-2-S antibodies to neutralize VSV-based SARS-CoV-2-S-expressing pseudotyped virus was assessed using a neutralization fluorescence focus assay. The binding results of three assays are summarized below. The neutralization potency of antibody at each dilution is represented as a percentage compared to mock supernatant control. All antibodies demonstrated neutralization capacity, and particularly for the set of antibodies that were evaluated 1:100, those showing higher neutralization may represent more potent neutralization capacity.

TABLE 6

| Neutralization of VLPs | | | |
|---|---|---|---|
| Supernatant | Neutralization (1:4 dilution) | Neutralization (1:20 dilution) | Neutralization (1:100 dilution) |
| mAb10913 | 99.5 | 95.5 | 69.1 |
| mAb10914 | 94.2 | 74.8 | 43.6 |
| mAb10915 | 96.7 | 74.2 | 29.6 |
| mAb10932 | 99.8 | 94.6 | 68 |
| mAb10933 | 99.8 | 98.9 | 88.4 |
| mAb10934 | 99.9 | 99.8 | 98.4 |
| mAb10935 | 99.6 | 98.5 | 88.8 |
| mAb10936 | 99.7 | 99.1 | 92.9 |
| mAb10937 | 97.5 | 87.7 | 56.3 |
| mAb10920 | 99.5 | 95.5 | 69.1 |
| mAb10921 | 98.2 | 91.4 | 46.1 |
| mAb10922 | 99.8 | 99.1 | 88.4 |
| mAb10923 | 99.5 | 92.9 | 67.7 |
| mAb10924 | 98.1 | 85.4 | 55.2 |
| mAb10930 | 99.1 | 91.1 | 59 |
| mAb10938 | 98.1 | 83 | 54.2 |
| mAb10939 | 98.6 | 90.5 | 64 |
| mAb10940 | 97 | 89.9 | 66.4 |
| mAb10941 | 98.9 | 92.9 | 73.8 |
| mAb10982 | 97.4 | 83.8 | 44.5 |
| mAb10984 | 99.8 | 95.1 | 83.4 |
| mAb10985 | 99.7 | 88.4 | 63.5 |
| mAb10986 | 99.7 | 98 | 86 |
| mAb10987 | 99.3 | 97.7 | 94.6 |
| mAb10988 | 97.6 | 87.6 | 62.2 |
| mAb10989 | 100 | 99.8 | 98.2 |
| mAb10969 | 97.2 | 91 | 63.7 |
| mAb10970 | 99.6 | 96.7 | 82.4 |
| mAb10971 | 99.5 | 97 | 73.9 |
| mAb10964 | 99.7 | 99.7 | 94.1 |
| mAb10965 | 98.5 | 87.6 | 68.6 |
| mAb10966 | 99.5 | 95.5 | 76.2 |
| mAb10967 | 98.9 | 91.4 | 69.2 |
| mAb10954 | 99.8 | 96 | 70.7 |
| mAb10955 | 98.8 | 88.6 | 62.7 |
| mAb10956 | 97.1 | 84.1 | 61.6 |
| mAb10957 | 97.6 | 76.4 | 48 |
| mAb10977 | 95.5 | 79 | 47.7 |
| mAb11010 | 85 | 54 | NT |
| mAb11004 | 77 | 40 | NT |
| mAb11000 | 98 | 82 | NT |
| mAb11006 | 91 | 54 | NT |
| mAb11008 | 96 | 77 | NT |
| mAb10998 | 88 | 59 | NT |
| mAb10996 | 85 | 58 | NT |
| mAb11002 | 35 | −1 | NT |

*NT: not tested

Example 6: Characterization of Antibodies in an Antibody-Dependent Cell-Mediated Toxicity Surrogate Assay The ability of antibodies targeting the spike protein of SARS-CoV-2 to interact with FcγR3a, an Fc-receptor prominently expressed on natural killer (NK) cells that induces antibody dependent cell-mediated cytotoxicity (ADCC), was measured in a surrogate bioassay using reporter cells and target cells bound to antibodies. This assay used Jurkat T cells that were engineered to express the reporter gene luciferase under the control of the transcription factor NFAT (NFAT-Luc) along with the high affinity human FcγR3a $^{176}$Val allotype receptor (Jurkat/NFAT-Luc/hFcγR3a $^{176}$Val). Target cells were engineered Jurkat T cells expressing human CD20 (used as a positive control with a CD20-targeting human IgG1 antibody) and the full-length SARS-CoV-2 spike protein controlled by a doxycycline-inducible promoter. Reporter cells were incubated with target cells and engagement of FcγR3a via the Fc domain of human IgG1 antibodies bound to target cells led to the activation of the transcription factor NFAT in the reporter cells and drove the expression of luciferase which was then measured via a luminescence readout.

Jurkat T cells were engineered to constitutively express full length human CD20 (amino acids M1-P297 of NCBI accession number NP_690605.1), Tet3G transactivator protein (cloned using a Takara pEF1α-Tet3G Vector, Catalog #631167), as well as a doxycycline-inducible full-length SARS-CoV-2 spike protein (amino acids M1-T1273 of NCBI accession number YP_009724390.1). Engineered Jurkat/Tet3G/hCD20/SARS-CoV2 spike protein-expressing cells were sorted for high expression of the spike protein and subsequently maintained in RPMI+10% Tet-free FBS+P/S/G+500 μg/ml G418+1 μg/ml puromycin+250 μg/ml hygromycin growth medium.

Jurkat T cells were engineered to stably express a Nuclear Factor of Activated T-cells (NFAT) luciferase reporter construct along with the high affinity human FcγR3a $^{176}$Val allotype receptor (amino acids M1-K254 of NCBI accession number P08637 VAR 003960). Engineered reporter cells were maintained in RPMI1640+10% FBS+P/S/G+0.5 μg/ml puromycin+500 μg/ml G418 growth media.

36 hours prior to the start of the surrogate ADCC assay, $5\times10^5$ target cells/ml were induced in RPMI+10% Tet-free FBS+P/S/G cell culture media containing 1 μg/ml doxycycline (Sigma). A day before the experiment, reporter cells were split to a density of $7.5\times10^5$ cells/ml in RPMI 1640+10% FBS+P/S/G+0.5 μg/ml puromycin+500 μg/ml G418 growth media.

Briefly, on the day of the experiment, the target and reporter cells were transferred into assay media (RPMI+10% Tet-free FBS+P/S/G) and added at a 3:2 ratio ($3\times10^4$/well target cells and $2\times10^4$/well reporter cells) to 384-well white microtiter plates, followed by the addition of anti-SARS-CoV-2-S antibody supernatant of varying concentrations. A positive control (CD20 antibody with human IgG1) sample and a negative control sample containing no antibody was included on each plate to normalize detected ADCC activities of anti-SARS-CoV-2-S antibody supernatants. Plates were incubated at 37° C./5% $CO_2$ for 5 h followed by the addition of an equal volume of ONE-Glo™ (Promega) reagent to lyse cells and detect luciferase activity. The emitted light was captured in Relative Light Units (RLU) on a multi-label plate reader Envision (PerkinElmer), and data was analyzed and normalized using the following equation:

$$ADCC\ \text{activity (\%)} = 100\times\frac{(\text{Mean } RLU \text{ (test samples)} - \text{Mean } RLU \text{ (background signal)})}{(\text{Mean } RLU \text{ (positive samples)} - \text{Mean } RLU \text{ (background signal)})}$$

The ability of anti-SARS-CoV-2-S antibodies to activate FcγR3a receptors was evaluated in a surrogate ADCC assay using Jurkat/NFAT-Luc/FcγR3a $^{176}$ Val) as reporter cells and Jurkat/hCD20/SARS-CoV2 Spike as target cells. Each antibody tested contained an IgG1 domain.

Table 7 summarizes the results, showing the raw luciferase activity and the calculated % of positive control are indicated. A range of % ADCC activity was observed indicating FcγR3a activation by the antibody supernatants. All samples demonstrated some measure of surrogate ADCC activity, and 10 of the antibody supernatants demonstrated surrogate ADCC activity better than observed in positive controls.

TABLE 7

ADCC surrogate activity of anti-SARS-CoV-2-S antibody supernatants.

| mAb | ADCC Mean RLU | ADCC (Activity (%) |
|---|---|---|
| mAb10913 | 11,480 | 111.9 |
| mAb10914 | 21,960 | 265.8 |
| mAb10915 | 14,280 | 153 |
| mAb10932 | 13,020 | 108.8 |
| mAb10933 | 9,740 | 68.5 |
| mAb10934 | 11,680 | 92 |
| mAb10935 | 11,540 | 90.4 |
| mAb10936 | 15,160 | 133.8 |
| mAb10937 | 12,340 | 100.1 |
| mAb10920 | 15,480 | 137.8 |
| mAb10921 | 10,080 | 67.7 |
| mAb10922 | 9,140 | 56.3 |
| mAb10923 | 13,340 | 107.1 |
| mAb10924 | 7,220 | 33 |
| mAb10930 | 8,900 | 53.4 |
| mAb10938 | 12,960 | 102.5 |
| mAb10939 | 9,440 | 59.7 |
| mAb10940 | 12,520 | 106.2 |
| mAb10941 | 10,340 | 77.2 |
| mAb10982 | 7,900 | 59.4 |
| mAb10984 | 6780 | 6.8 |
| mAb10985 | 5840 | 2.8 |
| mAb10986 | 6200 | 4.4 |
| mAb10987 | 12020 | 29.4 |
| mAb10988 | 7200 | 8.7 |
| mAb10989 | 10200 | 21.5 |
| mAb10969 | 10500 | 23.1 |
| mAb10970 | 7640 | 10.6 |
| mAb10971 | 7480 | 10 |
| mAb10964 | 6380 | 5.1 |
| mAb10965 | 6780 | 6.9 |
| mAb10966 | 7080 | 10.4 |
| mAb10967 | 6740 | 8.6 |
| mAb10954 | 6940 | 9.8 |
| mAb10955 | 6740 | 8.7 |
| mAb10956 | 6760 | 8.8 |
| mAb10957 | 7120 | 10.8 |
| mAb10977 | 12980 | 33.8 |

Example 7: Anti-SARS-CoV-2-S Antibody Binding Specificity Assay

A Luminex binding assay was performed to determine the binding of anti-SARS-CoV-2-S antibodies to a panel of antigens. For this assay, antigens were amine-coupled or captured by streptavidin to Luminex microspheres as follows: approximately 10 million MagPlex microspheres (Luminex Corp., MagPlex Microspheres, Cat. No. MC10000 and MC12000), were resuspended by vortexing in 500 µL 0.1M $NaPO_4$, pH 6.2 (activation buffer) and then centrifuged to remove the supernatant. Microspheres were protected from light, as they are light sensitive. The microspheres were resuspended in 160 µL of activation buffer and the carboxylate groups (—COOH) were activated by addition of 20 µL of 50 mg/mL of N-hydroxysuccinimide (NHS, Thermo Scientific, Cat. No. 24525) followed by addition of 20 µL of mg/mL 1-ethyl-3-[3-dimethylaminopropyl]carbodiimide (EDC, ThermoScientific, Cat. No. 22980) at 25° C. After 10 minutes, the pH of the reaction was reduced to 5.0 with the addition of 600 µL 50 mM MES, pH 5 (coupling buffer), and the microspheres were vortexed and centrifuged to remove supernatant. The activated microspheres were immediately mixed with 500 µL of 25 µg/mL of the protein antigen or Streptavidin in coupling buffer and incubated for two hours at 25° C. The coupling reaction was quenched by addition of 50 µL of 1M Tris-HCl, pH 8.0 and the microspheres were vortexed, centrifuged, and washed three times with 800 µL of PBS 0.005% (Tween20 0.05%), to remove uncoupled proteins and other reaction components. Microspheres were resuspended in 1 mL of PBS 2% BSA 0.05% Na Azide at 10 million microspheres/mL. For Streptavidin capture of antigens, 500 µL of 12.5 µg/mL of biotinylated protein in PBS was added to Streptavidin-coupled microspheres and incubated for one hour at 25° C. Microspheres were vortexed, centrifuged, and washed three times with 800 µL of PBS, and then blocked using 500 µL 30 mM Biotin (MilliporeSigma, Cat. No. B4501) in 0.15M Tris pH 8.0. Microspheres were incubated for 30 minutes then vortexed, centrifuged, and washed three times with 800 µL of PBS. Microspheres were resuspended in 1 mL of PBS 2% BSA 0.05% Na Azide at 10 million microspheres/mL.

Microspheres for the different proteins and biotinylated proteins were mixed at 2700 beads/ml, and 75 µL of microspheres were plated per well on a 96 well ProcartaPlex flat bottom plate (ThermoFisher, Cat. No: EPX-44444-000) and mixed with 25 µL of individual anti-SARS-CoV-2 supernatant containing antibody. Samples and microspheres were incubated for two hours at 25° C. and then washed twice with 200 µL of DPBS with 0.05% Tween 20. To detect bound antibody levels to individual microspheres, 100 µL of 2.5 µg/mL R-Phycoerythrin conjugated goat F(ab')2 anti-human kappa (Southern Biotech, Cat #2063-09) in blocking buffer (for antibodies with murine Fc regions) or 100 µL of 1.25 µg/mL R-Phycoerythrin AffiniPure $F(ab')_2$ Fragment Goat Anti-Mouse IgG, F(ab')2 Fragment Specific (Jackson Immunoresearch, Cat. No: 115-116-072) in blocking buffer (for antibodies with human Fc regions), was added and incubated for 30 minutes at 25° C. After 30 minutes, the samples were washed twice with 200 µl of washing buffer and resuspended in 150 µL of wash buffer. The plates were read in a Luminex FlexMap 3D® (Luminex Corp.) and Luminex xPonent® software version 4.3 (Luminex Corp.). The SARS-CoV-2 proteins used in the assay are as follows:

RBD_(R319-F541).mmh: SEQ ID NO: 829

RBD_(R319-F541).mFc: SEQ ID NO: 830

RBD_(R319-F541).hFc): SEQ ID NO: 831

The results of the Luminex binding are shown in Table 8 and Table 9 as median fluorescence intensity (MFI) signal intensities. The results show that the 46 anti-SARS-CoV-2-S antibody supernatants bound specifically to SARS-CoV-2-S RBD proteins. These results also show that five of these antibodies cross-react with SARS Coronavirus spike RBD proteins with binding signal greater than 1000 MFI.

TABLE 8

Binding signal (MFI) of SARS-CoV-2 Spike RBD, SARS-CoV-2 Spike S1, SARS RBD, SARS Spike S1, MERS Spike and MERS RBD proteins to anti-SARS-CoV-2 monoclonal antibodies (with hFc)

| | SARS-CoV-2 | | | | | | | | |
|---|---|---|---|---|---|---|---|---|---|
| Super-natant | SARS-CoV-2 Spike Protein (RBD) (R319-F541) · mmH | SARS-CoV-2 Spike Protein (RBD) (R319-F541) · mmH | Bt-SARS-CoV-2 Spike Protein (RBD) (R319-F541) · mFc | SARS-CoV-2 Spike Protein (RBD) (R319-F541) · mFc | Bt-SARS-CoV-2 Spike Protein (RBD) (R319-F541) · mFc | SARS-CoV-2 Spike Protein (RBD) (R319-F541) · hFc | SARS-CoV-2 Spike (RBD, Fc Tag) (Sino 40592-V05H) | SARS-CoV-2 Spike Protein (S1 Subunit, Fc Tag) (Sino 40591-V02H) | SARS-CoV-2 Spike Protein (S1 Subunit, His Tag) (Sino 40591-V08H) |
| mAb10913 | 30709 | 29247 | 16645 | 33023 | 27452 | 31929 | 31561 | 18899 | 24931 |
| mAb10914 | 31967 | 29650 | 15986 | 30740 | 25957 | 30464 | 30591 | 14914 | 21609 |
| mAb10915 | 31795 | 30293 | 20062 | 31772 | 30625 | 32437 | 31267 | 17595 | 22917 |
| mAb10932 | 29984 | 30133 | 17697 | 30640 | 26220 | 30559 | 29880 | 17627 | 22099 |
| mAb10933 | 33356 | 32090 | 19383 | 34944 | 30110 | 35106 | 34484 | 21178 | 27509 |
| mAb10934 | 33797 | 32649 | 21238 | 34325 | 33016 | 35841 | 33636 | 20643 | 27483 |
| mAb10935 | 34853 | 32603 | 19328 | 35886 | 31444 | 35611 | 35037 | 19991 | 25554 |
| mAb10936 | 33947 | 32305 | 21636 | 33740 | 32810 | 33912 | 33613 | 19487 | 25187 |
| mAb10937 | 33866 | 32225 | 19689 | 34233 | 31501 | 34624 | 33878 | 19553 | 26404 |
| mAb10920 | 34842 | 34440 | 20254 | 36415 | 31708 | 36828 | 36277 | 21085 | 28516 |
| mAb10921 | 24977 | 23596 | 11307 | 19429 | 18186 | 22306 | 21766 | 8959 | 12212 |
| mAb10922 | 31768 | 30755 | 18629 | 32355 | 27854 | 33609 | 31376 | 18287 | 24678 |
| mAb10923 | 35208 | 34289 | 19593 | 37372 | 33555 | 37756 | 36324 | 22502 | 28855 |
| mAb10924 | 29730 | 27987 | 17044 | 28308 | 26898 | 28744 | 28423 | 15672 | 20577 |
| mAb10930 | 25119 | 25131 | 16563 | 28560 | 25922 | 28870 | 28744 | 16530 | 21151 |
| mAb10938 | 29409 | 27069 | 17205 | 30533 | 24638 | 29593 | 29134 | 15431 | 21163 |
| mAb10939 | 32196 | 30883 | 18746 | 33900 | 28857 | 32864 | 32472 | 18171 | 23928 |
| mAb10940 | 35221 | 35290 | 21000 | 35978 | 30675 | 36507 | 34945 | 21350 | 25807 |
| mAb10941 | 32392 | 31171 | 20428 | 34061 | 28431 | 33347 | 33232 | 19668 | 26738 |
| mAb10982 | 24263 | 22180 | 12278 | 23296 | 19935 | 23020 | 23066 | 10847 | 14017 |
| mAb10984 | 27854 | 26197 | 17054 | 28350 | 22479 | 28442 | 27808 | 15590 | 19245 |
| mAb10985 | 30214 | 27854 | 15488 | 29443 | 24827 | 31054 | 28936 | 16219 | 20787 |

TABLE 8-continued

| | | | | | | | | | |
|---|---|---|---|---|---|---|---|---|---|
| mAb10986 | 27187 | 25196 | 15921 | 28407 | 23388 | 27693 | 27693 | 16034 | 19061 |
| mAb10987 | 32171 | 29074 | 16736 | 33115 | 26059 | 32757 | 31238 | 17465 | 23089 |
| mAb10988 | 23858 | 22160 | 12659 | 26095 | 21793 | 24822 | 23949 | 12910 | 16208 |
| mAb10989 | 17687 | 17286 | 11189 | 19568 | 16117 | 22435 | 19316 | 12263 | 14234 |
| mAb10969 | 29550 | 27587 | 15391 | 31386 | 26565 | 31042 | 30950 | 18466 | 23959 |
| mAb10970 | 33154 | 31662 | 20184 | 34739 | 29182 | 34991 | 34704 | 21047 | 24625 |
| mAb10971 | 29355 | 28850 | 16660 | 28746 | 24602 | 30032 | 29848 | 16986 | 21579 |
| mAb10964 | 31754 | 28907 | 19225 | 32420 | 27736 | 33074 | 32317 | 18650 | 24154 |
| mAb10965 | 30812 | 26863 | 13707 | 27139 | 23351 | 29618 | 28034 | 14133 | 18864 |
| mAb10966 | 30939 | 27440 | 17905 | 30363 | 25115 | 30778 | 29869 | 16403 | 23308 |
| mAb10967 | 28453 | 26496 | 16771 | 29650 | 24263 | 28660 | 28061 | 15776 | 21869 |
| mAb10954 | 30410 | 28281 | 18394 | 31284 | 24677 | 31768 | 29604 | 16626 | 21270 |
| mAb10955 | 29627 | 28476 | 16785 | 30790 | 24689 | 31227 | 31054 | 17858 | 22675 |
| mAb10956 | 27900 | 25690 | 12891 | 28349 | 24505 | 30225 | 28810 | 15013 | 19981 |
| mAb10957 | 23411 | 20615 | 10566 | 18692 | 16725 | 22560 | 20258 | 8451 | 11989 |
| mAb10977 | 16770 | 14605 | 8845 | 13827 | 12774 | 15216 | 16783 | 6476 | 9406 |

Binding signal (MFI) of SARS-CoV-2 Spike RBD, SARS-CoV-2 Spike S1, SARS RBD, SARS Spike S1, MERS Spike and MERS RBD proteins to anti-SARS-CoV-2 monoclonal antibodies (with hFc)

| | SARS | | | MERS | | | | | | | |
|---|---|---|---|---|---|---|---|---|---|---|---|
| Supernatant | Human SARS Coronavirus Spike Protein (Receptor Binding Domain) rabbit Fc (Sino 40150-V31B2) | Human SARS Coronavirus Spike Protein (Receptor Binding Domain, His Tag) (Sino 40150-V08B2) | Human SARS Coronavirus Spike S1 Subunit Protein (His Tag) (Sino 40150-V08B1) | MERS-CoV (SARS-CoV-2) Spike Protein (ECD, aa 1-1297, His Tag) (Sino 40069-V08B) | MERS-CoV (SARS-CoV-2) Spike Protein S2 (aa 726-1296, His Tag) (Sino 40070-V08B) | MERS-CoV (SARS-CoV-2) Spike Protein S1 (aa 1-725, His Tag) (Sino 40069-V08H) | MERS-CoV (NCoV/Novel coronavirus) Spike Protein fragment (RBD, aa 367-606, His Tag) (Sino 40071-V08B1) | MERS-CoV (NCoV/Novel coronavirus) Spike Protein S1 Protein (aa 1-725, His Tag) (Sino 40069-V08B1) | MERS · mFc (mAb2663-L1) | MERS · hFc (mAb2664-L1) | Bt-MERS · hFc (mAb2664-L2) |
| mAb10913 | 35 | 39 | 21 | 20 | 26 | 14 | 34 | 26 | 29 | 28 | 29 |
| mAb10914 | 47 | 39 | 22 | 19 | 28 | 15 | 31 | 23 | 86 | 71 | 49 |
| mAb10915 | 42 | 40 | 21 | 18 | 23 | 15 | 31 | 24 | 86 | 91 | 56 |
| mAb10932 | 34 | 26 | 19 | 14 | 19 | 12 | 26 | 19 | 60 | 49 | 40 |
| mAb10933 | 39 | 31 | 18 | 14 | 19 | 14 | 24 | 17 | 22 | 21 | 26 |
| mAb10934 | 38 | 27 | 18 | 15 | 18 | 10 | 24 | 20 | 77 | 68 | 47 |
| mAb10935 | 37 | 25 | 21 | 15 | 18 | 14 | 25 | 17 | 74 | 67 | 42 |
| mAb10936 | 46 | 36 | 20 | 19 | 21 | 13 | 29 | 20 | 32 | 26 | 32 |
| mAb10937 | 44 | 50 | 21 | 19 | 26 | 14 | 27 | 22 | 21 | 23 | 29 |
| mAb10920 | 59 | 68 | 26 | 24 | 30 | 13 | 39 | 27 | 38 | 35 | 44 |
| mAb10921 | 35 | 31 | 19 | 19 | 19 | 12 | 23 | 18 | 55 | 44 | 39 |
| mAb10922 | 36 | 41 | 18 | 19 | 18 | 9 | 29 | 22 | 20 | 21 | 24 |
| mAb10923 | 53 | 66 | 29 | 23 | 36 | 14 | 37 | 25 | 24 | 29 | 39 |
| mAb10924 | 41 | 30 | 18 | 17 | 19 | 12 | 29 | 22 | 19 | 22 | 28 |
| mAb10930 | 42 | 49 | 19 | 16 | 20 | 14 | 27 | 22 | 29 | 24 | 29 |
| mAb10938 | 38 | 36 | 19 | 16 | 19 | 13 | 25 | 20 | 86 | 65 | 46 |
| mAb10939 | 38 | 50 | 19 | 16 | 18 | 14 | 27 | 19 | 41 | 27 | 30 |
| mAb10940 | 32 | 28 | 20 | 15 | 18 | 11 | 22 | 19 | 18 | 21 | 25 |
| mAb10941 | 45 | 37 | 22 | 19 | 22 | 15 | 30 | 24 | 82 | 69 | 47 |
| mAb10982 | 30 | 54 | 24 | 17 | 21 | 13 | 29 | 20 | 64 | 60 | 42 |
| mAb10984 | 33 | 31 | 22 | 21 | 25 | 13 | 29 | 20 | 237 | 341 | 172 |
| mAb10985 | 31537 | 32343 | 22721 | 18 | 28 | 14 | 31 | 22 | 168 | 195 | 159 |
| mAb10986 | 39 | 38 | 21 | 15 | 19 | 14 | 27 | 20 | 233 | 286 | 184 |
| mAb10987 | 33 | 27 | 22 | 15 | 23 | 15 | 28 | 23 | 196 | 235 | 172 |
| mAb10988 | 41 | 67 | 25 | 17 | 29 | 14 | 32 | 25 | 169 | 181 | 130 |
| mAb10989 | 47 | 73 | 21 | 16 | 22 | 11 | 24 | 19 | 161 | 206 | 186 |
| mAb10969 | 37 | 34 | 20 | 16 | 20 | 11 | 26 | 19 | 21 | 22 | 29 |
| mAb10970 | 38 | 25 | 19 | 14 | 16 | 15 | 23 | 17 | 35 | 23 | 28 |
| mAb10971 | 32 | 31 | 20 | 15 | 13 | 13 | 20 | 19 | 44 | 29 | 24 |
| mAb10964 | 19999 | 23855 | 5186 | 15 | 17 | 13 | 20 | 19 | 19 | 22 | 26 |
| mAb10965 | 30 | 23 | 16 | 19 | 20 | 12 | 26 | 23 | 58 | 53 | 43 |
| mAb10966 | 35 | 21 | 20 | 16 | 16 | 12 | 24 | 16 | 56 | 53 | 42 |
| mAb10967 | 35 | 30 | 21 | 17 | 19 | 13 | 23 | 21 | 61 | 71 | 45 |
| mAb10954 | 30 | 26 | 15 | 17 | 16 | 10 | 18 | 21 | 57 | 61 | 41 |
| mAb10955 | 36 | 21 | 14 | 15 | 18 | 16 | 20 | 19 | 57 | 48 | 42 |
| mAb10956 | 32 | 24 | 16 | 15 | 16 | 13 | 22 | 24 | 58 | 49 | 41 |
| mAb10957 | 32 | 22 | 16 | 15 | 18 | 11 | 22 | 19 | 40 | 29 | 28 |
| mAb10977 | 36 | 28 | 23 | 17 | 19 | 13 | 24 | 21 | 17 | 20 | 25 |

TABLE 9

Binding signal (MFI) of SARS-CoV-2 RBD, SARS-CoV-2 Spike S1, SARS RBD, SARS Spike S1, MERS SPIKE and MERS RBD proteins to anti-SARS-CoV-2-S monoclonal antibodies (with mFc)

| | SARS-CoV-2 | | | | | | | | |
|---|---|---|---|---|---|---|---|---|---|
| Supernatant | SARS-CoV-2 Spike Protein (RBD) (R319-F541) · mmH (mAb10620-L1) | SARS-CoV-2 Spike Protein (RBD) (R319-F541) · mmH (mAb10620-L2) | Bt-SARS-CoV-2 Spike Protein (RBD) (R319-F541) · mFc (mAb10621-L2) | SARS-CoV-2 Spike Protein (RBD) (R319-F541) · mFc (mAb10621-L1) | Bt-SARS-CoV-2 Spike Protein (RBD) (R319-F541) · mFc (mAb10622-L2) | SARS-CoV-2 Spike Protein (RBD) (R319-F541) · hFc (mAb10622-L1) | SARS-CoV-2 Spike (RBD, Fc Tag) (Sino 40592-V05H) | SARS-CoV-2 (2019-nCoV) Spike Protein (S1 Subunit, Fc Tag) (Sino 40591-V02H) | SARS-CoV-2 (2019-nCoV) Spike Protein (S1 Subunit, His Tag) (Sino 40591-V08H) t |
| mAb11010 | 11024 | 12885 | 9349 | 14432 | 15688 | 8880 | 9628 | 5136 | 10794 |
| mAb11004 | 3350 | 11337 | 4299 | 4583 | 7625 | 4877 | 6905 | 4482 | 9526 |
| mAb11000 | 17802 | 10971 | 11335 | 23007 | 11593 | 22316 | 5671 | 9356 | 5415 |
| mAb11006 | 5134 | 4744 | 1396 | 2866 | 3812 | 3985 | 3749 | 2052 | 1037 |
| mAb11008 | 4047 | 3178 | 3047 | 4260 | 4106 | 2570 | 2311 | 6880 | 1419 |
| mAb10998 | 1847 | 3837 | 2228 | 2230 | 467 | 1740 | 2005 | 724 | 717 |
| mAb10996 | 9142 | 2906 | 4319 | 8738 | 5398 | 2084 | 16101 | 1425 | 6232 |
| mAb11002 | 11558 | 10181 | 2197 | 9530 | 5471 | 9382 | 8461 | 1107 | 2867 |

Binding signal (MFI) of SARS-CoV-2 RBD, SARS-CoV-2 Spike S1, SARS RBD, SARS Spike S1, MERS SPIKE and MERS RBD proteins to anti-SARS-CoV-2-S monoclonal antibodies (with mFc)

| | SARS | | | MERS | | | | | | | |
|---|---|---|---|---|---|---|---|---|---|---|---|
| Supernatant | Human SARS Corona-virus Spike Protein (Receptor Binding Domain) rabbit Fc (Sino 40150-V31B2) | Human SARS Corona-virus Spike Protein (Receptor Binding Domain, His Tag) (Sino 40150-V08B2) | Human SARS Corona-virus Spike S1 Subunit Protein (His Tag) (Sino 40150-V08B1) | MERS-CoV (NCoV/ Novel corona-virus) Spike Protein (ECD, aa 1-1297, His Tag) (Sino 40069-V08B) | MERS-CoV (NCoV/ Novel corona-virus) Spike Protein S2 (aa 726-1296, His Tag) (Sino 40070-V08B) | MERS-CoV (NCoV/ Novel corona-virus) Spike Protein S1 (aa 1-725, His Tag) (Sino 40069-V08H) | MERS-CoV (NCoV/ Novel corona-virus) Spike Protein fragment (RBD, aa 367-606, His Tag) (Sino 40071-V08B1) | MERS-CoV (NCoV/ Novel corona-virus) Spike Protein S1 Protein (aa 1-725, His Tag) (Sino 40069-V08B1) | MERS. mFc (mAb2663-L1) | MERS. hFc (mAb2664-L1) | Bt-MERS. hFc (mAb2664-L2) |
| mAb11010 | 18276 | 16793 | 7421 | 7 | 14 | 14 | 19 | 18 | 134 | 28 | 28 |
| mAb11004 | 5524 | 740 | 33 | 15 | 20 | 12 | 26 | 17 | 228 | 24 | 25 |
| mAb11000 | 39 | 31 | 18 | 13 | 19 | 9 | 27 | 17 | 384 | 82 | 49 |
| mAb11006 | 615 | 667 | 339 | 18 | 17 | 13 | 15 | 18 | 156 | 16 | 24 |
| mAb11008 | 120 | 174 | 31 | 18 | 16 | 15 | 20 | 18 | 45 | 19 | 32 |
| mAb10998 | 29 | 37 | 16 | 19 | 18 | 14 | 24 | 19 | 48 | 29 | 32 |
| mAb10996 | 1355 | 1279 | 28 | 13 | 21 | 14 | 26 | 18 | 185 | 132 | 95 |
| mAb11002 | 80 | 56 | 31 | 10 | 22 | 13 | 25 | 18 | 288 | 52 | 32 |

Example 8: Anti-SARS-CoV-2-S Antibody Diversity Assay

A binding assay was performed to determine the binding profile of anti-SARS-CoV-2-S antibodies. For this assay, antigens were amine coupled as described for the Luminex binding assay above. Briefly, approximately 9 million MagPlex microspheres for 16 different bead regions (Luminex Corp., MagPLex Microspheres, Cat. No. MagPLex MC10000 and MC12000), were resuspended by vortexing in 500 μL 0.1M $NaPO_4$, pH 6.2 and then centrifuged to remove the supernatant. The microspheres were resuspended in 160 μL of activation buffer and the carboxylate groups (—COOH) were activated by addition of 20 μL of 50 mg/mL of N-hydroxysuccinimide (NHS, Thermo Scientific, Cat #24525) followed by addition of 20 μL of 50 mg/mL of 1-ethyl-3-[3-dimethylaminopropyl]carbodiimide (EDC, ThermoScientific, Cat #22980) at 25° C. After 10 minutes, the pH of the reaction was reduced to 5.0 with the addition of 600 μL of 50 mM MES, pH 5 (coupling buffer), and the microspheres were vortexed and centrifuged to remove supernatant. The activated microspheres were immediately mixed with 500 μL of 20 μg/mL of SARS-CoV-2 Spike Protein (RBD)(R319-F541)-mmH in coupling buffer and incubated for two hours at 25° C. The coupling reaction was quenched by addition of 50 μL of 1M Tris-HCl, pH 8.0 and the microspheres were vortexed, centrifuged, and washed three times with 1000 μL of PBS. Microspheres were resuspended in 250 μL of PBS at 9 million microspheres/mL.

15 out of the 16 microsphere regions with amine-coupled protein were modified for the binning assay as follows: microspheres were washed twice with PBS 5% DMSO, and 500 μl of a chemical or enzyme were dissolved per manufacturing recommendations and added at 10 nM to the amine-coupled microspheres described above. This was subsequently vortexed and incubated for 2 hours at room temperature with rotation. Wash microspheres 3 times with PBS 2% BSA. Microspheres were resuspended in 1 mL of PBS at 9 million microspheres/mL.

Protein-modified and protein-unmodified (intact) microspheres were mixed at 2700 beads/ml, and 75 μL of microspheres were plated per well on a 96 well ProcartaPlex 96 well flat bottom plate (ThermoFisher, Cat. No: EPX-44444-000) and mixed with 25 μL of individual anti-SARS-CoV-2-S supernatant-containing antibody. Samples and microspheres were incubated for two hours at 25° C. and then washed twice with 200 μL of DPBS with 0.05% Tween 20. To detect bound antibody levels to individual microspheres, 100 μL of 2.5 μg/mL R-Phycoerythrin conjugated goat F(ab')2 anti-human kappa (Southern Biotech, Cat #2063-09) in blocking buffer (for antibodies with hFc), or 100 μL of 1.25 μg/mL R-Phycoerythrin AffiniPure F(ab')2 Fragment Goat Anti-Mouse IgG, F(ab')2 Fragment Specific (Jackson Immunoresearch, Cat. No: 115-116-072) in blocking buffer (for antibodies with mFc), or 100 μL of 1.25 μg/mL R-Phycoerythrin Anti-His (Biolegend, Cat. No: 362603) in blocking buffer (for ACE-2 control, R&D, Cat. No. 933-ZN), was added and incubated for 30 minutes at 25° C. After 30 minutes, the samples were washed twice with 20011.1 of washing buffer and resuspended in 150 μL of wash buffer. The plates were read in FlexMap 3D® (Luminex Corp.) and Luminex xPonent® software version 4.3 (Luminex Corp.).

The results of the Luminex binning results are shown in Table 10 as median fluorescence intensity (MFI) signal intensities. To determine clusters, data was normalized to the intact protein (unmodified microspheres) and clustered. The 46 anti-SARS-CoV-2 antibodies were classified in 9 clusters with 2 or more antibodies, and 11 antibodies were classified as single nodes. Clusters were assigned by based on these results of the hierarchical clustering and dendrogram. These results show that the 46 anti-SARS-CoV-2-S antibody supernatants had diverse binding characteristics and profiles, suggesting that the collection of antibodies bound to different epitopes on the SARS-CoV-2 spike protein.

TABLE 10

Binding signal (MFI) and cluster assignment of anti-SARS-CoV-2-S monoclonal antibodies to SARS-COV-2-S RBD · mmH (unmodified and chemically or enzymatically modified)

| Sample | CLUSTER | UN-MODIFIED-SARS-CoV-2 Spike Protein (RBD)(R319-F541) · mmH | MOD1-SARS-CoV-2 Spike Protein (RBD)(R319-F541) · mmH | MOD2-SARS-CoV-2 Spike Protein (RBD)(R319-F541) · mmH | MOD3-SARS-CoV-2 Spike Protein (RBD)(R319-F541) · mmH | MOD4-SARS-CoV-2 Spike Protein (RBD)(R319-F541) · mmH | MOD5-SARS-CoV-2 Spike Protein (RBD)(R319-F541) · mmH | MOD6-SARS-CoV-2 Spike Protein (RBD)(R319-F541) · mmH | MOD7-SARS-CoV-2 Spike Protein (RBD)(R319-F541) · mmH |
|---|---|---|---|---|---|---|---|---|---|
| Human_ACE2 (10 nM) | 1 | 5727 | 873 | 5119 | 1852 | 5106 | 202 | 5408 | 5013 |
| Human_ACE2 (100 nM) | 1 | 10681 | 1447 | 10320 | 2260 | 9661 | 559 | 9593 | 8624 |
| Human_ACE2 (50 nM) | 1 | 9269 | 991 | 8238 | 2185 | 7707 | 391 | 7859 | 7577 |
| mAb10969 | 3 | 28551 | 54 | 24177 | 425 | 26049 | 3546 | 20577 | 23878 |
| mAb10965 | 3 | 28080 | 38 | 21996 | 135 | 25727 | 3250 | 22419 | 24062 |
| mAb10913 | 4 | 31694 | 102 | 28389 | 23270 | 29344 | 5018 | 28738 | 27854 |
| mAb10920 | 4 | 35534 | 162 | 26783 | 28090 | 32185 | 7105 | 32942 | 30958 |
| mAb10923 | 4 | 38711 | 153 | 32305 | 33866 | 36082 | 7540 | 35335 | 33924 |
| mAb10930 | 4 | 29502 | 110 | 21579 | 21533 | 27843 | 6195 | 26600 | 25103 |
| mAb10940 | 4 | 38871 | 94 | 34337 | 33453 | 36690 | 7817 | 36128 | 34544 |
| mAb10989 | 4 | 19671 | 49 | 16697 | 18260 | 15785 | 3369 | 19568 | 15206 |
| mAb11006 | 4 | 2044 | 30 | 705 | 3773 | 2553 | 517 | 2024 | 2503 |
| mAb10934 | 5 | 33057 | 81 | 27716 | 25092 | 31664 | 6648 | 30801 | 29926 |
| mAb10924 | 5 | 39205 | 118 | 32707 | 29366 | 36507 | 6378 | 35565 | 34210 |
| mAb10939 | 5 | 33647 | 62 | 24895 | 26392 | 31390 | 6276 | 31275 | 29594 |
| mAb10988 | 5 | 23009 | 68 | 15983 | 14842 | 20830 | 3536 | 20176 | 19499 |
| mAb10957 | 5 | 20879 | 52 | 15728 | 19383 | 19993 | 3582 | 17727 | 17989 |
| mAb10914 | 6 | 36047 | 143 | 32282 | 26967 | 34199 | 7162 | 32787 | 31823 |
| mAb10915 | 6 | 36690 | 159 | 32489 | 26427 | 33545 | 9731 | 33568 | 31823 |
| mAb10932 | 6 | 34024 | 191 | 28833 | 28557 | 31560 | 9946 | 31123 | 29765 |
| mAb10938 | 6 | 34522 | 174 | 28465 | 19403 | 31252 | 8932 | 29225 | 30918 |
| mAb10941 | 6 | 36369 | 140 | 31868 | 26129 | 33637 | 9455 | 33154 | 31478 |
| mAb10984 | 6 | 25759 | 109 | 22445 | 20925 | 24747 | 6880 | 23630 | 23895 |
| mAb10985 | 6 | 27394 | 99 | 24286 | 22986 | 26151 | 5519 | 25874 | 25023 |
| mAb10986 | 6 | 25414 | 118 | 20868 | 20557 | 23619 | 6591 | 23066 | 22813 |
| mAb10977 | 6 | 16980 | 54 | 14108 | 16590 | 15851 | 3505 | 14528 | 12779 |
| mAb10933 | 7 | 35267 | 69 | 30617 | 5243 | 32665 | 6161 | 32930 | 31043 |
| mAb10982 | 7 | 27505 | 80 | 20338 | 6650 | 25051 | 4585 | 24178 | 23770 |
| mAb10987 | 7 | 29327 | 54 | 25311 | 2235 | 27981 | 4110 | 27095 | 25690 |
| mAb10935 | 8 | 31883 | 81 | 28683 | 12724 | 30329 | 6457 | 27417 | 27785 |
| mAb10970 | 8 | 32271 | 94 | 26863 | 22547 | 30537 | 7029 | 27679 | 28333 |
| mAb10971 | 8 | 27415 | 106 | 23890 | 22184 | 27850 | 6869 | 25337 | 25164 |
| mAb10964 | 8 | 29963 | 122 | 23580 | 23419 | 27896 | 7085 | 27483 | 25968 |
| mAb10921 | 9 | 31657 | 91 | 28216 | 18123 | 30441 | 6821 | 28629 | 28756 |
| mAb10966 | 9 | 29489 | 85 | 22836 | 19866 | 25736 | 5869 | 24217 | 26013 |
| mAb10967 | 9 | 26784 | 107 | 20787 | 13760 | 25104 | 6192 | 21329 | 23434 |
| mAb10954 | 9 | 28476 | 74 | 21915 | 19038 | 26186 | 5948 | 25299 | 24332 |

TABLE 10-continued

| | | | | | | | | | |
|---|---|---|---|---|---|---|---|---|---|
| mAb10955 | 9 | 28637 | 39 | 24585 | 21155 | 27912 | 4141 | 23849 | 24862 |
| mAb10996 | S1 | 3403 | 20 | 5275 | 164 | 5562 | 488 | 3042 | 9125 |
| mAb10937 | S2 | 33561 | 94 | 24890 | 104 | 31164 | 5904 | 30327 | 28675 |
| mAb10936 | S3 | 32919 | 136 | 26818 | 312 | 31261 | 7856 | 31008 | 29293 |
| mAb10922 | S4 | 33183 | 102 | 25384 | 1107 | 31348 | 5822 | 31313 | 29386 |
| mAb11002 | S5 | 9881 | 16 | 3348 | 155 | 8615 | 153 | 9542 | 7562 |
| mAb10956 | S6 | 24562 | 29 | 21685 | 19337 | 23769 | 2275 | 19422 | 21961 |
| mAb11010 | S7 | 6388 | 18 | 4155 | 5441 | 8832 | 384 | 7444 | 5766 |
| mAb11008 | S8 | 7096 | 26 | 926 | 1525 | 2776 | 198 | 2750 | 1007 |
| mAb10998 | S9 | 2557 | 18 | 247 | 1336 | 1524 | 104 | 2937 | 723 |
| mAb11004 | S10 | 6514 | 18 | 2205 | 604 | 3566 | 1155 | 4522 | 2229 |
| mAb11000 | S11 | 16670 | 19 | 3416 | 12787 | 13493 | 2009 | 17756 | 12409 |

Binding signal (MFI) and cluster assignment of anti-SARS-COV-2-S monoclonal antibodies to SARS-COV-2-S RBD · mmH (unmodified and chemically or enzymatically modified)

| Sample | MOD8-SARS-CoV-2 Spike Protein (RBD)(R 319-F541) · mmH | MOD9-SARS-CoV-2 Spike Protein (RBD)(R 319-F541) · mmH | MOD10-SARS-CoV-2 Spike Protein (RBD)(R 319-F541) · mmH | MOD11-SARS-CoV-2 Spike Protein (RBD)(R 319-F541) · mmH | MOD12-SARS-CoV-2 Spike Protein (RBD)(R 319-F541) · mmH | MOD13-SARS-CoV-2 Spike Protein (RBD)(R 319-F541) · mmH | MOD14-SARS-CoV-2 Spike Protein (RBD)(R 319-F541) · mmH | MOD15-SARS-CoV-2 Spike Protein (RBD)(R 319-F541) · mmH |
|---|---|---|---|---|---|---|---|---|
| Human_ACE2 (10 nM) | 36 | 4500 | 4091 | 4618 | 4505 | 5094 | 4743 | 3173 |
| Human_ACE2 (100 nM) | 36 | 6212 | 7922 | 8440 | 8957 | 8948 | 7927 | 5370 |
| Human_ACE2 (50 nM) | 35 | 5518 | 6447 | 7064 | 7233 | 7600 | 7112 | 4407 |
| mAb10969 | 154 | 18918 | 24407 | 22409 | 27036 | 24269 | 23672 | 14196 |
| mAb10965 | 110 | 19061 | 22355 | 21414 | 25635 | 23144 | 23156 | 14072 |
| mAb10913 | 15939 | 28645 | 27110 | 28878 | 31159 | 28971 | 27784 | 26272 |
| mAb10920 | 17228 | 32758 | 31463 | 31910 | 35144 | 32185 | 32323 | 29949 |
| mAb10923 | 20961 | 34187 | 33809 | 36323 | 38596 | 35381 | 33338 | 33131 |
| mAb10930 | 10235 | 23744 | 24516 | 26738 | 27958 | 26968 | 25126 | 23951 |
| mAb10940 | 14572 | 35967 | 34704 | 36070 | 39285 | 35462 | 34922 | 33614 |
| mAb10989 | 6136 | 17756 | 15530 | 16838 | 15137 | 17411 | 18100 | 15946 |
| mAb11006 | 299 | 2442 | 3749 | 1076 | 4622 | 2818 | 3344 | 3568 |
| mAb10934 | 6410 | 31261 | 30364 | 30709 | 32873 | 30502 | 28591 | 27785 |
| mAb10924 | 6594 | 32856 | 33797 | 35875 | 38424 | 34647 | 33476 | 31524 |
| mAb10939 | 4808 | 28465 | 29444 | 30699 | 33475 | 30596 | 29721 | 27129 |
| mAb10988 | 2980 | 18329 | 19660 | 20692 | 21770 | 20130 | 18948 | 16558 |
| mAb10957 | 2171 | 17357 | 19487 | 18596 | 21247 | 18757 | 17810 | 16081 |
| mAb10914 | 5475 | 31226 | 31467 | 33235 | 35175 | 32626 | 31100 | 29217 |
| mAb10915 | 9277 | 33442 | 31984 | 32902 | 35462 | 31937 | 32397 | 30009 |
| mAb10932 | 9711 | 30122 | 29074 | 30433 | 33379 | 30283 | 29880 | 26795 |
| mAb10938 | 7536 | 28109 | 30308 | 31264 | 33394 | 30814 | 30538 | 27751 |
| mAb10941 | 7518 | 29802 | 31421 | 33958 | 35290 | 32925 | 31777 | 29159 |
| mAb10984 | 3527 | 20212 | 22065 | 22318 | 26163 | 23227 | 22283 | 19349 |
| mAb10985 | 6821 | 23642 | 23572 | 24654 | 27394 | 24677 | 24493 | 20787 |
| mAb10986 | 2838 | 20672 | 21766 | 21720 | 25207 | 23400 | 22214 | 19694 |
| mAb10977 | 4005 | 14193 | 12616 | 13320 | 16332 | 13632 | 14312 | 13136 |
| mAb10933 | 1556 | 27705 | 29926 | 30801 | 34427 | 30409 | 30525 | 24367 |
| mAb10982 | 1065 | 20361 | 23131 | 23247 | 26412 | 24027 | 23549 | 16765 |
| mAb10987 | 1444 | 25621 | 25345 | 26335 | 29995 | 27049 | 26082 | 22871 |
| mAb10935 | 2534 | 26151 | 27958 | 28752 | 30847 | 28522 | 27452 | 24816 |
| mAb10970 | 1968 | 25233 | 27793 | 27610 | 31869 | 29871 | 26909 | 23775 |
| mAb10971 | 1598 | 22587 | 25646 | 24384 | 27391 | 25761 | 24774 | 19590 |
| mAb10964 | 2414 | 24740 | 25658 | 26439 | 29113 | 27243 | 26783 | 22405 |
| mAb10921 | 941 | 23674 | 27586 | 27367 | 30969 | 28480 | 28331 | 21220 |
| mAb10966 | 833 | 21800 | 24332 | 24977 | 27440 | 26554 | 24585 | 18580 |
| mAb10967 | 574 | 19521 | 22352 | 22997 | 25506 | 22641 | 22836 | 17387 |
| mAb10954 | 929 | 22237 | 24516 | 23457 | 28200 | 24897 | 24539 | 19717 |
| mAb10955 | 1141 | 22191 | 24805 | 23688 | 27210 | 25575 | 24677 | 18944 |
| mAb10996 | 28 | 8940 | 6336 | 6789 | 6229 | 5821 | 3484 | 1312 |
| mAb10937 | 1231 | 27597 | 27092 | 29937 | 32116 | 29661 | 29386 | 20543 |
| mAb10936 | 2916 | 29074 | 28775 | 30813 | 31711 | 29189 | 28522 | 21674 |
| mAb10922 | 2248 | 29845 | 28629 | 30373 | 32931 | 30625 | 28962 | 23399 |
| mAb11002 | 17 | 4144 | 6415 | 6790 | 8465 | 7688 | 6804 | 2016 |
| mAb10956 | 331 | 16954 | 21282 | 21524 | 26646 | 21547 | 22767 | 15077 |
| mAb11010 | 162 | 5567 | 6718 | 9557 | 12522 | 5287 | 5898 | 4915 |
| mAb11008 | 60 | 2350 | 2759 | 2824 | 3301 | 2745 | 2130 | 2831 |
| mAb10998 | 85 | 1611 | 2260 | 1206 | 2513 | 2186 | 727 | 1029 |
| mAb11004 | 71 | 1465 | 12665 | 10667 | 5925 | 5531 | 11578 | 1144 |
| mAb11000 | 56 | 14151 | 19230 | 17204 | 21718 | 17952 | 17117 | 5151 |

Example 9: Biacore Binding Kinetics of Anti-SARS-CoV-2-S Monoclonal Antibodies Equilibrium dissociation constants ($K_D$) for different SARS-CoV-2-S antibodies from primary supernatants from CHOt cells or from hybridomas were determined using a real-time surface plasmon resonance-based Biacore T200/Biacore 8K biosensor. All binding studies were performed in 10 mM HEPES, 150 mM NaCl, 3 mM EDTA, and 0.05% v/v Surfactant Tween-20, pH 7.4 (HBS-ET) running buffer at 25° C. The Biacore CM5 sensor chip surface was first derivatized by amine coupling with either mouse anti-human Fc specific mAb or rabbit anti-mouse Fcγ monoclonal antibody (GE, Catalog #BR-1008-38) to capture anti-SARS-CoV-2 antibodies. Binding studies were performed on a human SARS-CoV-2 RBD extracellular domain expressed with a C-terminal myc-myc-hexahistidine tag (SARS-CoV-2 RBD-MMH), SARS-CoV-2 RBD extracellular domain expressed with a C-terminal mouse IgG2a (SARS-CoV-2 RBD-mFc), or SARS-CoV-2 RBD extracellular domain expressed with a C-terminal human IgG1 (SARS-CoV-2 RBD-hFc). Single concentrations of SARS-CoV-2 RBD-MMH, (100 nM); SARS-CoV-2 RBD-mFc (50 nM), or SARS-CoV-2 RBD-hFc (50 nM), prepared in HBS-ET running buffer, were injected for 1.5 minutes at a flow rate of 30 μL/min while the dissociation of antibody-bound different SARS-CoV-2 RBD reagents was monitored for 2 minutes in HBS-ET running buffer. At the end of each cycle, the SARS-CoV-2 RBD antibody capture surface was regenerated using either a 10 sec injection of 20 mM phosphoric acid for the mouse anti-human Fc specific monoclonal antibody surface or a 40 sec injection of 10 mM Glycine, HCl, pH1.5 for the rabbit anti-mouse Fcγ specific polyclonal antibody. The association rate ($k_a$) and dissociation rate ($k_d$) were determined by fitting the real-time binding sensorgrams to a 1:1 binding model with mass transport limitation using BiaEvaluation software v3.1 or Biacore Insight Evaluation software v2.0. or curve-fitting software. Binding dissociation equilibrium constant ($K_D$) and dissociative half-life ($t_{1/2}$) were calculated from the kinetic rates as:

$$K_D(M) = \frac{kd}{ka},$$

and $$t\frac{1}{2}\ (\text{min}) = \frac{\ln(2)}{60 * kd}$$

Binding kinetics parameters for different SARS-CoV-2 monoclonal antibodies binding to different anti-SARS-CoV-2 RBD reagents of the invention at 25° C. are shown in Tables 11 and 12.

TABLE 11

Binding kinetics of SARS-COV-2 RBD-MMH binding to anti-SARS-CoV-2 monoclonal antibodies at 25° C.

| Supernatant | mAb Capture Level (RU) | 50 nM Ag Bound (RU) | $k_a$ (1/Ms) | $k_d$ (1/s) | KD (M) | t½ (min) |
|---|---|---|---|---|---|---|
| mAb10913 | 2010 | 381 | 4.91E+05 | 2.28E-02 | 4.64E-08 | 0.5 |
| mAb10914 | 3169 | 174 | 3.49E+05 | 1.36E-02 | 3.89E-08 | 0.8 |

TABLE 11-continued

Binding kinetics of SARS-COV-2 RBD-MMH binding to anti-SARS-CoV-2 monoclonal antibodies at 25° C.

| Supernatant | mAb Capture Level (RU) | 50 nM Ag Bound (RU) | $k_a$ (1/Ms) | $k_d$ (1/s) | KD (M) | t½ (min) |
|---|---|---|---|---|---|---|
| mAb10915 | 824 | 109 | 8.85E+04 | 3.18E-04 | 3.59E-09 | 36.3 |
| mAb10932 | 2261 | 326 | 8.50E+04 | 1.26E-04 | 1.48E-09 | 92 |
| mAb10933 | 1414 | 428 | 1.05E+06 | 4.08E-03 | 3.88E-09 | 2.8 |
| mAb10934 | 2918 | 981 | 1.01E+06 | 4.35E-03 | 4.32E-09 | 2.7 |
| mAb10935 | 3293 | 694 | 2.11E+05 | 3.99E-03 | 1.89E-08 | 2.9 |
| mAb10936 | 2491 | 717 | 3.03E+05 | 8.81E-04 | 2.91E-09 | 13.1 |
| mAb10937 | 1846 | 504 | 3.81E+05 | 5.73E-03 | 1.50E-08 | 2 |
| mAb10920 | 1295 | 234 | 6.22E+05 | 2.20E-02 | 3.54E-08 | 0.5 |
| mAb10921 | 1024 | 141 | 9.52E+04 | 4.99E-04 | 5.24E-09 | 23.1 |
| mAb10922 | 2395 | 786 | 3.91E+05 | 2.00E-03 | 5.11E-09 | 5.8 |
| mAb10923 | 1278 | 322 | 2.94E+05 | 6.04E-03 | 2.06E-08 | 1.9 |
| mAb10924 | 766 | 166 | 1.97E+05 | 3.65E-03 | 1.85E-08 | 3.2 |
| mAb10930 | 3137 | 328 | 8.90E+04 | 1.85E-03 | 2.08E-08 | 6.2 |
| mAb10938 | 2167 | 180 | 6.60E+04 | 3.48E-04 | 5.28E-09 | 33.2 |
| mAb10939 | 1505 | 241 | 1.69E+05 | 3.38E-03 | 2.00E-08 | 3.4 |
| mAb10940 | 2149 | 698 | 3.34E+05 | 2.38E-03 | 7.15E-09 | 4.9 |
| mAb10941 | 1811 | 288 | 9.85E+04 | 5.17E-04 | 5.25E-09 | 22.3 |
| mAb10982 | 1096 | 188 | 1.32E+05 | 2.71E-03 | 2.06E-08 | 4.3 |
| mAb10984 | 1654 | 387 | 1.55E+05 | 3.70E-04 | 2.39E-09 | 31.2 |
| mAb10985 | 1974 | 749 | 9.41E+05 | 1.45E-03 | 1.54E-09 | 8 |
| mAb10986 | 1560 | 524 | 3.21E+05 | 2.56E-04 | 7.97E-10 | 45.2 |
| mAb10987 | 1242 | 356 | 4.50E+05 | 1.04E-02 | 2.32E-08 | 1.1 |
| mAb10988 | 1227 | 291 | 1.27E+06 | 3.52E-02 | 2.77E-08 | 0.3 |
| mAb10989 | 692 | 257 | 1.60E+06 | 3.14E-03 | 1.96E-09 | 3.7 |
| mAb10969 | 2200 | 427 | 1.80E+05 | 4.71E-03 | 2.61E-08 | 2.5 |
| mAb10970 | 1865 | 438 | 1.37E+05 | 7.99E-04 | 5.82E-09 | 14.4 |
| mAb10971 | 1482 | 358 | 1.68E+05 | 4.49E-04 | 2.67E-09 | 25.8 |
| mAb10964 | 1208 | 460 | 1.06E+06 | 7.56E-04 | 7.14E-10 | 15.3 |
| mAb10965 | 1046 | 168 | 1.19E+05 | 2.73E-03 | 2.28E-08 | 4.2 |
| mAb10966 | 1422 | 343 | 1.57E+05 | 4.40E-04 | 2.81E-09 | 26.3 |
| mAb10967 | 1421 | 175 | 1.12E+05 | 1.08E-04 | 9.66E-10 | 106.9 |
| mAb10954 | 1150 | 338 | 2.34E+05 | 4.05E-04 | 1.73E-09 | 28.5 |
| mAb10955 | 1032 | 199 | 1.38E+05 | 2.69E-03 | 1.95E-08 | 4.3 |
| mAb10956 | 1303 | 184 | 2.02E+05 | 5.31E-03 | 2.62E-08 | 2.2 |
| mAb10957 | 736 | 163 | 1.34E+05 | 3.15E-04 | 2.35E-09 | 36.7 |
| mAb10977 | 221 | 57 | 2.33E+05 | 7.17E-04 | 3.08E-09 | 16.1 |

TABLE 11-continued

Binding kinetics of SARS-COV-2 RBD-MMH binding to anti-SARS-CoV-2 monoclonal antibodies at 25° C.

| Supernatant | mAb Capture Level (RU) | 50 nM Ag Bound (RU) | $k_a$ (1/Ms) | $k_d$ (1/s) | KD (M) | t½ (min) |
|---|---|---|---|---|---|---|
| mAb11010 | 1027 | 108 | 3.35E+05 | 1.48E–03 | 4.42E–09 | 7.8 |
| mAb11004 | 1111 | 161 | 1.88E+05 | 3.12E–03 | 1.66E–08 | 3.7 |
| mAb11000 | 381 | 16 | 1.40E+05 | 2.41E–02 | 1.72E–07 | 0.5 |
| mAb11006 | 1118 | 49 | 8.97E+04 | 3.67E–04 | 4.10E–09 | 31.5 |
| mAb11008 | 887 | 56 | 6.73E+04 | 4.00E–03 | 5.94E–08 | 2.9 |
| mAb10998 | 1155 | 69 | 1.95E+05 | 2.28E–02 | 1.17E–07 | 0.5 |
| mAb10996 | 616 | 28 | 1.53E+05 | 1.10E–02 | 7.18E–08 | 1.1 |
| mAb11002 | 1070 | 8 | 3.21E+05 | 2.54E–02 | 7.93E–08 | 0.5 |

TABLE 12

Binding kinetics of SARS-COV-2 RBD-mFc or SARS-COV-2 RBD-hFc binding to anti-SARS-CoV-2-S monoclonal antibodies at 25° C.

| Supernatant | mAb Capture Level (RU) | 50 nM Ag Bound (RU) | $k_a$ (1/Ms) | $k_d$ (1/s) | KD (M) | t½ (min) |
|---|---|---|---|---|---|---|
| mAb10913 | 961 | 575 | 6.23E+05 | 1.52E–04 | 2.44E–10 | 76.1 |
| mAb10914 | 1467 | 313 | 1.83E+05 | 1.00E–05* | 5.47E–11 | 1155* |
| mAb10915 | 392 | 141 | 2.81E+05 | 1.00E–05% | 3.56E–11 | 1155* |
| mAb10932 | 1060 | 372 | 2.42E+05 | 1.00E–05* | 4.13E–11 | 1155* |
| mAb10933 | 681 | 465 | 1.23E+06 | 2.12E–04 | 1.73E–10 | 54.4 |
| mAb10934 | 1401 | 949 | 1.41E+06 | 1.17E–04 | 8.32E–11 | 98.3 |
| mAb10935 | 1667 | 830 | 3.83E+05 | 1.00E–05* | 2.61E–11 | 1155* |
| mAb10936 | 1171 | 699 | 6.52E+05 | 1.00E–05* | 1.53E–11 | 1155* |
| mAb10937 | 904 | 575 | 6.39E+05 | 7.28E–05 | 1.14E–10 | 158.7 |
| mAb10920 | 617 | 357 | 7.02E+05 | 2.92E–04 | 4.16E–10 | 39.5 |
| mAb10921 | 489 | 170 | 2.66E+05 | 1.00E–05* | 3.75E–11 | 1155* |
| mAb10922 | 1286 | 828 | 7.19E+05 | 2.42E–05 | 3.36E–11 | 478.2 |
| mAb10923 | 613 | 362 | 6.51E+05 | 2.83E–05 | 4.35E–11 | 407.7 |
| mAb10924 | 465 | 223 | 3.67E+05 | 8.13E–05 | 2.22E–10 | 142.1 |
| mAb10930 | 2156 | 449 | 2.32E+05 | 1.00E–05* | 4.31E–11 | 1155* |
| mAb10938 | 1363 | 333 | 3.11E+05 | 1.00E–05* | 3.22E–11 | 1155* |
| mAb10939 | 904 | 324 | 2.99E+05 | 1.15E–05 | 3.87E–11 | 1004.3 |
| mAb10940 | 1508 | 893 | 5.61E+05 | 2.86E–05 | 5.09E–11 | 403.8 |
| mAb10941 | 1132 | 371 | 2.60E+05 | 1.00E–05* | 2.15E–11 | 1155* |
| mAb10982 | 529 | 236 | 3.10E+05 | 1.69E–05 | 5.44E–11 | 683.6 |
| mAb10984 | 1213 | 573 | 4.02E+05 | 1.00E–05* | 2.49E–11 | 1155* |
| mAb10985 | 1463 | 1040 | 1.09E+06 | 1.27E–05 | 1.17E–11 | 910.9 |
| mAb10986 | 1168 | 752 | 6.33E+05 | 1.00E–05* | 1.58E–11 | 1155* |
| mAb10987 | 902 | 632 | 8.20E+05 | 1.70E–04 | 2.08E–10 | 67.8 |
| mAb10988 | 892 | 628 | 1.24E+06 | 3.46E–04 | 2.79E–10 | 33.4 |

TABLE 12-continued

Binding kinetics of SARS-COV-2 RBD-mFc or SARS-COV-2 RBD-hFc binding to anti-SARS-CoV-2-S monoclonal antibodies at 25° C.

| Supernatant | mAb Capture Level (RU) | 50 nM Ag Bound (RU) | $k_a$ (1/Ms) | $k_d$ (1/s) | KD (M) | t½ (min) |
|---|---|---|---|---|---|---|
| mAb10989 | 505 | 378 | 2.07E+06 | 9.30E-05 | 4.50E-11 | 124.2 |
| mAb10969 | 1658 | 738 | 3.05E+05 | 1.51E-05 | 4.96E-11 | 764 |
| mAb10970 | 1370 | 661 | 3.48E+05 | 1.00E-05* | 2.88E-11 | 1155* |
| mAb10971 | 1081 | 556 | 3.95E+05 | 1.00E-05* | 2.53E-11 | 1155* |
| mAb10964 | 875 | 651 | 1.43E+06 | 1.00E-05* | 7.00E-12 | 1155* |
| mAb10965 | 762 | 322 | 2.97E+05 | 1.00E-05* | 3.36E-11 | 1155* |
| mAb10966 | 921 | 430 | 4.02E+05 | 1.00E-05* | 2.49E-11 | 1155* |
| mAb10967 | 945 | 355 | 3.99E+05 | 1.00E-05* | 2.51E-11 | 1155* |
| mAb10954 | 734 | 414 | 5.77E+05 | 1.00E-05* | 1.73E-11 | 1155* |
| mAb10955 | 634 | 292 | 3.96E+05 | 2.34E-05 | 5.92E-11 | 493.6 |
| mAb10956 | 842 | 339 | 3.74E+05 | 1.48E-04 | 3.95E-10 | 78 |
| mAb10957 | 449 | 209 | 3.58E+05 | 1.00E-05* | 2.79E-11 | 1155* |
| mAb10977 | 161 | 102 | 5.56E+05 | 1.04E-04 | 1.87E-10 | 110.9 |
| mAb11010 | 1014 | 163 | 4.24E+05 | 1.00E-05* | 2.36E-11 | 1155* |
| mAb11004 | 1101 | 241 | 3.46E+05 | 6.63E-05 | 1.91E-10 | 174.2 |
| mAb11000 | 380 | 61 | 4.38E+05 | 1.83E-03 | 4.17E-09 | 6.3 |
| mAb11006 | 1112 | 75 | 1.88E+05 | 1.00E-05* | 5.32E-11 | 1155* |
| mAb11008 | 872 | 110 | 1.61E+05 | 1.15E-04 | 7.15E-10 | 100.4 |
| mAb10998 | 1140 | 227 | 3.30E+05 | 5.21E-04 | 1.58E-09 | 22.2 |
| mAb10996 | 629 | 83 | 2.88E+05 | 9.32E-04 | 3.24E-09 | 12.4 |
| mAb11002 | 1068 | 60 | 2.69E+05 | 4.49E-03 | 1.67E-08 | 2.6 |

*Estimated value based on the limit of measurement of the dissociative rate constant and dissociative half-life under the experimental conditions.

Example 10: Characterization of Anti-SARS-CoV-2-S Monoclonal Antibodies by Blocking ELISA An ELISA-based blocking assay was developed to determine the ability of anti-SARS-CoV2-S antibodies to block the binding of the SARS-CoV-2 spike protein receptor binding domain (RBD) to human angiotensin converting enzyme 2 (hACE2).

The SARS-CoV-2 protein used in the experiments was comprised of the receptor binding domain (RBD) portion of the SARS-CoV-2 spike protein (amino acids Arg319 to Phe541) expressed with the Fc portion of the human IgG1 at the c-terminus (SARS-CoV-2 RBD-hFc; see NCBI accession number MN908947.3) The human ACE2 protein used in the experiments was purchased from R&D systems and is comprised of amino acids glutamine 18 to serine 740 with a c-terminal 10×-Histidine tag (hACE2-His; NCBI accession number Q9BYF1).

Experiments were carried out using the following procedure. A monoclonal anti-Penta-His antibody (Qiagen) was coated at 1 μg/ml in PBS on a 96-well microtiter plate overnight at 4° C. The hACE2-His receptor was added at 0.2 μg/ml in PBS and bound for 2 hours at room temperature. Nonspecific binding sites were subsequently blocked using a 0.5% (w/v) solution of BSA in PBS. In other microtiter plates, a constant amount of 10 pM or 15 pM (as indicated in Table 13) of SARS-CoV-2 RBD-hFc protein was bound with antibodies diluted 1:10 or 1:20 in PBS+0.5% BSA. These antibody-protein complexes, after a one-hour incubation, were transferred to the microtiter plate coated with hACE2-His. After 1.5 hours of incubation at RT, the wells were washed, and plate-bound SARS-CoV-2 RBD-hFc protein was detected with goat-anti-human IgG antibody conjugated with horseradish peroxidase (HRP) (Jackson). The plates were then developed using TMB substrate solution (BD Biosciences, catalog #555214) according to manufacturer's recommendation and absorbance at 450 nm was measured on a Victor X5 plate reader.

Data analysis was performed by calculating the % reduction of signal of the fixed SARS-CoV-2-S RBD-hFc concentration in the presence of the antibody vs in the absence of the antibody. In the calculation, binding signal of the sample of the constant SARS-CoV-2-S RBD-hFc without the presence of the antibody for each plate was referenced as 100% binding or 0% blocking; and the baseline signal of the sample of media only without the presence of SARS-CoV-2 RBD-hFc was referenced as 0% binding or 100% blocking.

The ability of anti-SARS-CoV-2-S antibodies to block SARS-CoV-2-S RBD from binding to human ACE2 was assessed using a blocking ELISA format. Single point test antibody supernatant blocking of either 10 pM or 15 pM SARS-CoV-2-S RBD-hFc binding to hACE2-His, which was presented on anti-His antibody coated on 96-well microtiter plates, was detected with an HRP conjugated anti-hFc antibody.

The blocking results of three assays are summarized in Table 13. The SARS-CoV-2-S binding signal (450 nm) and the G calculated % blocking are indicated. A range of blocking is observed for the test samples. For samples where an NA is indicated in columns 6 and 7, a plate-corrected value is included in columns 4 and 5, as data was consistent with a single plate switch occurring for those samples. 43 of 46 antibody supernatants blocked greater than 50% of the SARS-CoV-2-S RBD-hFc binding to plate-coated human ACE2, with 16 of them blocking >90% of the signal.

TABLE 13

Blocking ELISA Results

| Supernatant | SARS-CoV-2 RBD Fixed Concentration | Supernatant dilution | Plate corrected SARS-CoV-2 RBD-hFc Binding to His presented ACE2 (Abs 450 nm) | Plate corrected SARS-CoV-2 RBD-hFc Binding to His presented ACE2 % Blocking | SARS-CoV-2 RBD-hFc Binding to His presented ACE2 (Abs 450 nm) | SARS-CoV-2 RBD-hFc Binding to His presented ACE2 % Blocking |
|---|---|---|---|---|---|---|
| mAb10913 | 15 pM | 1:10 | 0.206 | 80.5 | 0.206 | 80.5 |
| mAb10914 | 15 pM | 1:10 | 0.326 | 59.1 | 0.326 | 59.1 |
| mAb10915 | 15 pM | 1:10 | 0.171 | 89.7 | 0.171 | 89.7 |
| mAb10932 | 15 pM | 1:10 | 0.254 | 57.3 | 0.254 | 57.3 |
| mAb10933 | 15 pM | 1:10 | 0.158 | 96.3 | 0.158 | 96.3 |
| mAb10934 | 15 pM | 1:10 | 0.209 | 78 | 0.209 | 78 |
| mAb10935 | 15 pM | 1:10 | 0.238 | 69.4 | 0.238 | 69.4 |
| mAb10936 | 15 pM | 1:10 | 0.234 | 70.6 | 0.234 | 70.6 |
| mAb10937 | 15 pM | 1:10 | 0.176 | 88.1 | 0.176 | 88.1 |
| mAb10920 | 15 pM | 1:10 | 0.601 | −56.5 | 0.601 | −56.5 |
| mAb10921 | 15 pM | 1:10 | 0.192 | 82.7 | 0.192 | 82.7 |
| mAb10922 | 15 pM | 1:10 | 0.181 | 86.4 | 0.181 | 86.4 |
| mAb10923 | 15 pM | 1:10 | 0.237 | 43.6 | 0.237 | 43.6 |
| mAb10924 | 15 pM | 1:10 | 0.175 | 78.2 | 0.175 | 78.2 |
| mAb10930 | 15 pM | 1:10 | 0.241 | 42.5 | 0.241 | 42.5 |
| mAb10938 | 15 pM | 1:10 | 0.169 | 87.5 | 0.169 | 87.5 |
| mAb10939 | 15 pM | 1:10 | 0.204 | 65.6 | 0.204 | 65.6 |
| mAb10940 | 15 pM | 1:10 | 0.152 | 95.2 | 0.152 | 95.2 |
| mAb10941 | 15 pM | 1:10 | 0.174 | 97.2 | 0.174 | 97.2 |
| mAb10982 | 15 pM | 1:10 | 0.195 | 83.5 | 0.195 | 83.5 |
| mAb10984 | 15 pM | 1:10 | 0.166 | 96.3 | NA | NA |
| mAb10985 | 15 pM | 1:10 | 0.162 | 97 | NA | NA |
| mAb10986 | 15 pM | 1:10 | 0.158 | 97.8 | NA | NA |
| mAb10987 | 15 pM | 1:10 | 0.243 | 81.8 | NA | NA |
| mAb10988 | 15 pM | 1:10 | 0.244 | 84 | 0.244 | 84 |
| mAb10989 | 15 pM | 1:10 | 0.155 | 101.8 | 0.155 | 101.8 |
| mAb10969 | 15 pM | 1:10 | 0.221 | 87.8 | 0.221 | 87.8 |
| mAb10970 | 15 pM | 1:10 | 0.164 | 97.7 | 0.164 | 97.7 |
| mAb10971 | 15 pM | 1:10 | 0.17 | 96.7 | 0.17 | 96.7 |
| mAb10964 | 15 pM | 1:10 | 0.169 | 96.9 | 0.169 | 96.9 |
| mAb10965 | 15 pM | 1:10 | 0.158 | 98.8 | 0.158 | 98.8 |
| mAb10966 | 15 pM | 1:10 | 0.157 | 94.2 | 0.157 | 94.2 |
| mAb10967 | 15 pM | 1:10 | 0.145 | 97.9 | 0.145 | 97.9 |
| mAb10954 | 15 pM | 1:10 | 0.147 | 97.3 | 0.147 | 97.3 |
| mAb10955 | 15 pM | 1:10 | 0.162 | 92.7 | 0.162 | 92.7 |
| mAb10956 | 15 pM | 1:10 | 0.189 | 84.5 | 0.189 | 84.5 |
| mAb10957 | 15 pM | 1:10 | 0.154 | 95.1 | 0.154 | 95.1 |
| mAb10977 | 15 pM | 1:10 | 0.315 | 71.5 | 0.315 | 71.5 |
| mAb11010 | 10 pM | 1:20 | 0.186 | 82.1 | 0.186 | 82.1 |
| mAb11004 | 10 pM | 1:20 | 0.211 | 70 | 0.211 | 70 |
| mAb11000 | 10 pM | 1:20 | 0.173 | 72.7 | 0.173 | 72.7 |
| mAb11006 | 10 pM | 1:20 | 0.236 | 58 | 0.236 | 58 |
| mAb11008 | 10 pM | 1:20 | 0.213 | 69.1 | 0.213 | 69.1 |
| mAb10998 | 10 pM | 1:20 | 0.185 | 61.6 | 0.185 | 61.6 |
| mAb10996 | 10 pM | 1:20 | 0.295 | −18.1 | 0.295 | −18.1 |
| mAb11002 | 10 pM | 1:20 | 0.177 | 79.2 | 0.177 | 79.2 |

Example 11: Epitope Mapping of Anti-SARS-CoV-2-S Monoclonal Antibodies to Spike Glycoprotein by Hydrogen-Deuterium Exchange Mass Spectrometry Hydrogen-Deuterium Exchange Mass Spectrometry (HDX-MS) was performed to determine the amino acid residues of the SARS-CoV-2 Spike Protein Receptor Binding Domain (RBD_(amino acids R319-F541)) that interact with mAb10989, mAb10987, mAb10934, mAb10933, mAb10920, mAb10922, mAb10936, mAb10954, mAb10964, mAb10977, mAb10984, and mAb10986. A general description of the HDX-MS method is set forth in e.g., Ehring (1999) *Analytical Biochemistry* 267(2):252-259; and Engen and Smith (2001) *Anal. Chem.* 73:256A-265A.

The HDX-MS experiments were performed on an integrated HDX-MS platform, consisting of a Leaptec HDX PAL system for the deuterium labeling and quenching, a Waters Acquity I-Class (Binary Solvent Manager) for the sample digestion and loading, a Waters Acquity I-Class (Binary Solvent Manager) for the analytical gradient, and a Thermo Q Exactive HF mass spectrometer for peptide mass measurement.

The labeling solution was prepared as PBS buffer in $D_2O$ at pD 7.0 (10 mM phosphate buffer, 140 mM NaCl, and 3 mM KCl, equivalent to pH 7.4 at 25° C.). For deuterium labeling, 10 μL of the RBD protein or RBD protein premixed with each one of the 12 antibodies listed above were incubated at 20° C. with 90 μL of $D_2O$ labeling solution for various timepoints, in duplicate. For mAb10989, mAb10987, mAb10934, and mAb10933, the time points were 0 min (non-deuterated control), 5 min, and 10 min. For mAb10920, mAb10922, mAb10936, mAb10954, mAb10964, mAb10977, mAb10984, and mAb10986, the time points were 0 min (non-deuterated control) and 10 min. The deuteration reaction was quenched by adding 90 μL of pre-chilled quench buffer (0.5 M TCEP-HCl, 4 M urea and 0.5% formic acid) to each sample for a 90 second incubation at 20° C. The quenched samples were then injected into the Leaptec HDX PAL system for online pepsin/protease XIII digestion. The digested peptides were trapped by a C18 column (2.1 mm×5 mm, Waters) and separated by another C18 column (2.1 mm×50 mm, Waters) at −5° C. with a 20 minute gradient (for mAb10989, mAb10987, mAb10934, and mAb10933) or a 10 minute gradient (for mAb10920, mAb10922, mAb10936, mAb10954, mAb10956, mAb10964, mAb10977, and mAb10984) from 0% to 90% of mobile phase B solution (mobile phase A solution: 0.5% formic acid and 4.5% acetonitrile in water, mobile phase B solution: 0.5% formic acid in acetonitrile). The eluted peptides were analyzed by a Thermo Q Exactive HF mass spectrometry in LC-MS/MS or LC-MS mode.

The LC-MS/MS data from the undeuterated RBD protein sample were searched against a database including amino acid sequences of the RBD protein, pepsin, protease XIII, and their reversed sequences using Byonic search engine (Protein Metrics). The search parameters were set as default using non-specific enzymatic digestion and human glycosylation as common variable modification. The list of identified peptides was then imported into HDExaminer software (version 3.1) to calculate the deuterium uptake (D-uptake) and differences in deuterium uptake percentage (Δ% D) for all deuterated samples. Difference in deuterium uptake percentage (Δ% D) was calculated as follows.

$$\text{Difference in deuterium uptake } (\Delta D) = D\text{-uptake }(RBD\text{-mAb}) - D\text{-uptake }(RBD\text{ alone})$$

$$\text{Difference in deuterium uptake percentage } (\Delta\%D) = \frac{\Delta D}{\text{Theoretical maximum } D \text{ uptake of the peptide}} \times 100$$

A total of 190 peptides from the RBD were identified from both RBD alone and RBD in complex with mAb10989 samples, representing 86.06% sequence coverage of the RBD. Any peptide that exhibited a reduction in deuterium uptake of 5% or greater (i.e., a Δ% D value of less than −5%, such as −6%, −10%, and so on) upon mAb binding was defined as significantly protected. Peptides corresponding to amino acids 467-513 (DISTEIYQAGSTPCNGVEGFNCYFPLQSYGFQPTNGVGYQPYRVVVL) (SEQ ID NO: 835) of the RBD were significantly protected by mAb10989.

A total of 187 peptides from the RBD were identified from both RBD alone and RBD in complex with mAb10987 samples, representing 86.06% sequence coverage of RBD. Any peptide that exhibited a reduction in deuterium uptake of 5% or greater (i.e., a Δ% D value of less than −5%, such as −6%, −10%, and so on) upon mAb binding was defined as significantly protected. Peptides corresponding to amino acids 432-452 (CVIAWNSNNLDSKVGGNYNYL) (SEQ ID NO: 836) of the RBD were significantly protected by mAb10987.

A total of 188 peptides from the RBD were identified from both RBD alone and RBD in complex with mAb10934 samples, representing 86.06% sequence coverage of the RBD. Any peptide that exhibited a reduction in deuterium uptake of 5% or greater (i.e., a Δ% D value of less than −5%, such as −6%, −10%, and so on) upon mAb binding was defined as significantly protected. Peptides corresponding to amino acids 432-452 (CVIAWNSNNLDSKVGGNYNYL) (SEQ ID NO: 836), 467-474 (DISTEIYQ) (SEQ ID NO: 837), and 480-513 (CNGVEGFNCYFPLQSYGFQPTNGVGYQPYRVVVL) (SEQ ID NO: 838) of the RBD were significantly protected by mAb10934.

A total of 188 peptides from the RBD were identified from both RBD alone and RBD in complex with mAb10933 samples, representing 86.06% sequence coverage of the RBD. Any peptide that exhibited a reduction in deuterium uptake of 5% or greater (i.e., a Δ% D value of less than −5%, such as −6%, −10%, and so on) upon mAb binding was defined as significantly protected. Peptides corresponding to amino acids 467-510 (DISTEIYQAGSTPCNGVEGFNCYFPLQSYGFQPTNGVGYQPYRV) (SEQ ID NO: 839) of the RBD were significantly protected by mAb10933.

A total of 75 peptides from the RBD were identified from both RBD alone and RBD in complex with mAb10920 samples, representing 83.27% sequence coverage of the RBD. Any peptide that exhibited a reduction in deuterium uptake of 5% or greater (i.e., a Δ% D value of less than −5%, such as −6%, −10%, and so on) upon mAb binding was defined as significantly protected. Peptides corresponding to amino acids 471-486 (EIYQAGSTPCNGVEGF) (SEQ ID NO: 840), and 491-515 (PLQSYGFQPTNGVGYQPYRVVVLSF) (SEQ ID NO: 841) of the RBD were significantly protected by mAb10920.

A total of 86 peptides from the RBD were identified from both RBD alone and RBD in complex with mAb10922 samples, representing 87.25% sequence coverage of the RBD. Any peptide that exhibited a reduction in deuterium uptake of 5% or greater (i.e., a Δ% D value of less than −5%, such as −6%, −10%, and so on) upon mAb binding was defined as significantly protected. Peptides corresponding to amino acids 432-452 (CVIAWNSNNLDSKVGGNYNYL) (SEQ ID NO: 836) of the RBD were significantly protected by mAb10922.

A total of 81 peptides from the RBD were identified from both RBD alone and RBD in complex with mAb10936 samples, representing 82.07% sequence coverage of the RBD. Any peptide that exhibited a reduction in deuterium uptake of 5% or greater (i.e., a Δ% D value of less than −5%, such as −6%, −10%, and so on) upon mAb binding was defined as significantly protected. Peptides corresponding to amino acids 351-360 (YAWNRKRISN) (SEQ ID NO: 842), 432-452 (CVIAWNSNNLDSKVGGNYNYL) (SEQ ID NO: 836), 467-486 (DISTEIYQAGSTPCNGVEGF) (SEQ ID NO: 843), and 491-513 (PLQSYGFQPTNGVGYQPYRVVVL) (SEQ ID NO: 844) of the RBD were significantly protected by mAb10936.

A total of 84 peptides from the RBD were identified from both RBD alone and RBD in complex with mAb10954 samples, representing 87.25% sequence coverage of the RBD. Any peptide that exhibited a reduction in deuterium uptake of 5% or greater (i.e., a Δ% D value of less than −5%, such as −6%, −10%, and so on) upon mAb binding was defined as significantly protected. Peptides corresponding to amino acids 400-422 (FVIRGDEVRQIAPGQTGKIADYN) (SEQ ID NO: 845), 453-486 (YRLFRKSNLKPFERDISTEIYQAGSTPCNGVEGF) (SEQ ID NO: 846), and 490-515 (FPLQSYGFQPTNGVGYQPYRVVVLSF) (SEQ ID NO: 847) of the RBD were significantly protected by mAb10954.

A total of 109 peptides from the RBD were identified from both RBD alone and RBD in complex with mAb10964 samples, representing 83.67% sequence coverage of RBD. Any peptide that exhibited a reduction in deuterium uptake of 5% or greater (i.e., a Δ% D value of less than −5%, such as −6%, −10%, and so on) upon mAb binding was defined as significantly protected. Peptides corresponding to amino acids 401-424 (VIRGDEVRQIAPGQTGKIADYNYK) (SEQ ID NO: 848), and 471-513 (EIYQAGSTPCNGVEGFNCYFPLQSYGFQPTNGVGYQPYRVVVL) (SEQ ID NO: 849) of the RBD were significantly protected by mAb10964.

A total of 78 peptides from the RBD were identified from both RBD alone and RBD in complex with mAb10977 samples, representing 87.25% sequence coverage of the RBD. Any peptide that exhibited a reduction in deuterium uptake of 5% or greater (i.e., a Δ% D value of less than −5%, such as −6%, −10%, and so on) upon mAb binding was defined as significantly protected. Peptides corresponding to amino acids 351-364 (YAWNRKRISNCVAD) (SEQ ID NO: 850), and 471-486 (EIYQAGSTPCNGVEGF) (SEQ ID NO: 840) of the RBD were significantly protected by mAb10977.

A total of 88 peptides from the RBD were identified from both RBD alone and RBD in complex with mAb10984 samples, representing 87.25% sequence coverage of RBD. Any peptide that exhibited a reduction in deuterium uptake of 5% or greater (i.e., a Δ% D value of less than −5%, such as −6%, −10%, and so on) upon mAb binding was defined as significantly protected. Peptides corresponding to amino acids 400-422 (FVIRGDEVRQIAPGQTGKIADYN) (SEQ ID NO: 845), and 453-486 (YRLFRKSNLKPFERDISTEIYQAGSTPCNGVEGF) (SEQ ID NO: 846) of the RBD were significantly protected by mAb10984.

A total of 84 peptides from the RBD were identified from both RBD alone and RBD in complex with mAb10986 samples, representing 87.25% sequence coverage of the RBD. Any peptide that exhibited a reduction in deuterium uptake of 5% or greater (i.e., a Δ% D value of less than −5%, such as −6%, −10%, and so on) upon mAb binding was defined as significantly protected. Peptides corresponding to amino acids 400-422 (FVIRGDEVRQIAPGQTGKIADYN) (SEQ ID NO: 845), 453-486 (YRLFRKSNLKPFERDISTEIYQAGSTPCNGVEGF) (SEQ ID NO: 846), and 490-515 (FPLQSYGFQPTNGVGYQPYRVVVLSF) (SEQ ID NO: 847) of the RBD were significantly protected by mAb10986.

Figure 15:
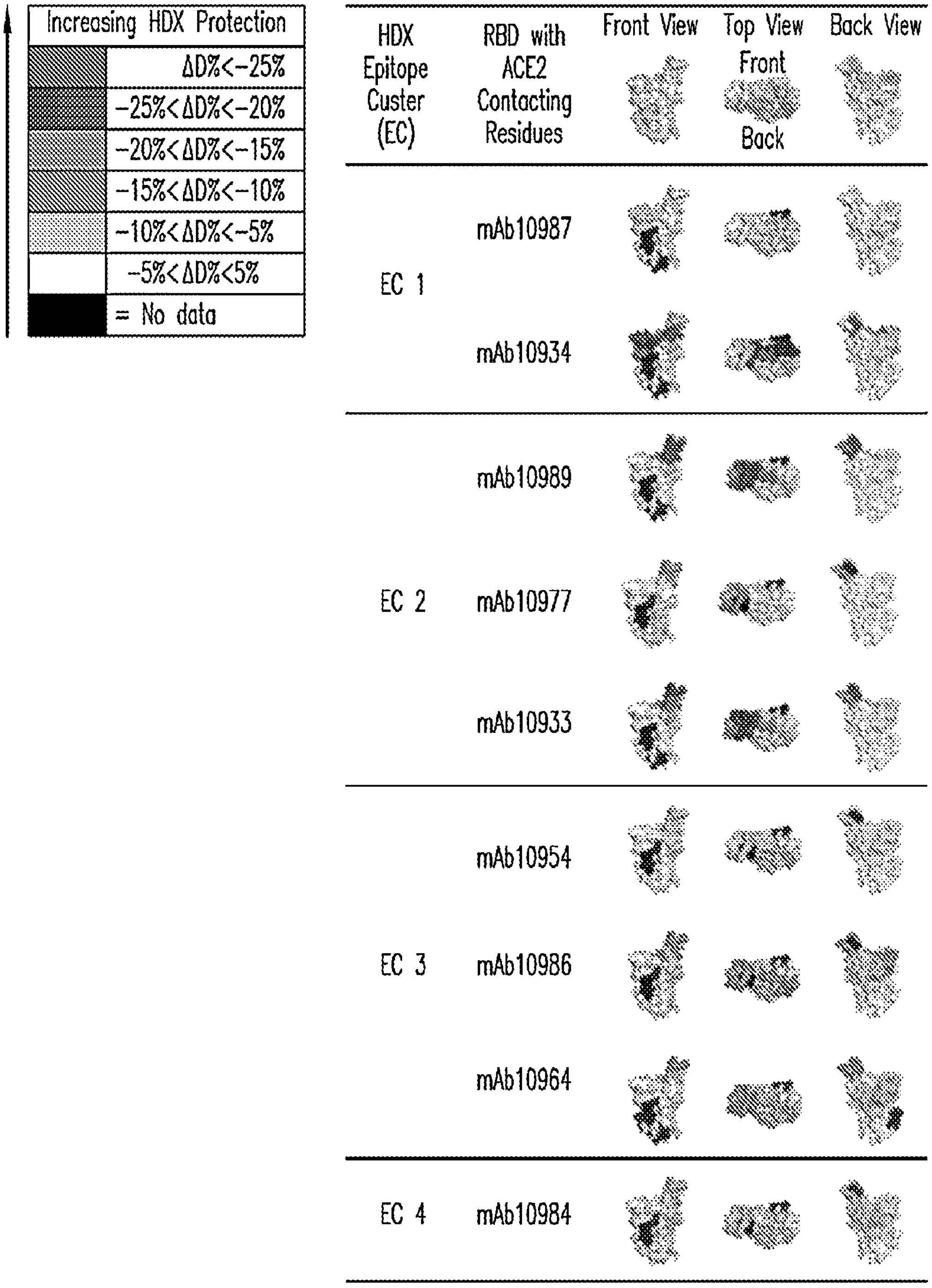
FIG. 15 displays a 3D surface model for the structure of the Spike protein RBD domain showing the ACE2 interface and HDX-MS epitope mapping results. The RBD structure is reproduced from PDB 6M17.

In sum, the majority of the neutralizing antibodies tested contact the RBD in a manner that overlaps the RBD residues that comprise the ACE2 interface; furthermore, the antibodies can be grouped based on their pattern of contacting the RBD surface, as shown in FIG. 15. The above data are also summarized in Tables 14-25.

TABLE 14

Spike protein receptor binding domain (RBD) peptides with significant protection upon formation of RBD-mAb compared to RBD alone

| | 5 min incubation | | | 10 min incubation | | | |
|---|---|---|---|---|---|---|---|
| RBD Residues | RBD-mAb10989 D-uptake | RBD D-uptake | ΔD | RBD-mAb10989 D-uptake | RBD D-uptake | ΔD | Δ % D |
| 467-474 | 2.67 | 3.16 | −0.49 | 2.53 | 3.17 | −0.64 | −10.5 |
| 470-473 | 0.48 | 0.98 | −0.50 | 0.47 | 0.98 | −0.51 | −28.0 |
| 470-474 | 0.99 | 1.46 | −0.47 | 0.99 | 1.44 | −0.45 | −16.9 |
| 471-474 | 0.51 | 0.89 | −0.38 | 0.51 | 0.89 | −0.38 | −20.9 |
| 475-486 | 2.20 | 2.93 | −0.73 | 2.11 | 2.94 | −0.83 | −9.7 |
| 475-487 | 3.31 | 4.50 | −1.19 | 3.61 | 4.48 | −0.87 | −11.4 |
| 475-489 | 2.77 | 4.48 | −1.71 | 2.78 | 4.53 | −1.75 | −16.0 |
| 475-490 | 2.63 | 4.96 | −2.33 | 2.67 | 4.97 | −2.30 | −19.8 |
| 480-489 | 1.82 | 3.67 | −1.85 | 1.77 | 3.69 | −1.92 | −26.2 |
| 483-486 | 0.31 | 0.78 | −0.47 | 0.30 | 0.78 | −0.48 | −26.5 |
| 487-489 | 0.05 | 0.40 | −0.35 | 0.02 | 0.39 | −0.37 | −40.4 |
| 487-490 | 0.11 | 0.90 | −0.79 | 0.11 | 0.84 | −0.73 | −42.3 |
| 487-491 | 0.10 | 1.05 | −0.95 | 0.10 | 1.03 | −0.93 | −52.0 |
| 487-495 | 0.62 | 1.59 | −0.97 | 0.67 | 1.57 | −0.90 | −17.4 |
| 487-509 | 5.63 | 6.99 | −1.36 | 5.68 | 7.02 | −1.34 | −8.3 |
| 487-510 | 6.08 | 7.37 | −1.29 | 6.08 | 7.44 | −1.36 | −7.7 |
| 487-512 | 5.72 | 6.48 | −0.76 | 5.60 | 6.77 | −1.17 | −5.1 |

TABLE 14-continued

Spike protein receptor binding domain (RBD) peptides with significant protection upon formation of RBD-mAb compared to RBD alone

| | 5 min incubation | | | 10 min incubation | | | |
|---|---|---|---|---|---|---|---|
| RBD Residues | RBD-mAb10989 D-uptake | RBD D-uptake | ΔD | RBD-mAb10989 D-uptake | RBD D-uptake | ΔD | Δ % D |
| 487-513 | 5.15 | 6.16 | −1.01 | 5.07 | 6.14 | −1.07 | −5.3 |
| 488-490 | 0.03 | 0.22 | −0.19 | 0.00 | 0.23 | −0.23 | −23.2 |
| 488-491 | 0.04 | 0.37 | −0.33 | 0.04 | 0.36 | −0.32 | −36.3 |

TABLE 15

Spike protein RBD peptides with significant protection upon formation of RBD-mAb10987 complex comparing to RBD alone

| | 5 min incubation | | | 10 min incubation | | | |
|---|---|---|---|---|---|---|---|
| RBD Residues | RBD-mAb10987 D-uptake | RBD D-uptake | ΔD | RBD-mAb10987 D-uptake | RBD D-uptake | ΔD | Δ % D |
| 432-441 | 1.62 | 2.17 | −0.55 | 1.64 | 2.18 | −0.54 | −7.6 |
| 432-449 | 5.60 | 6.59 | −0.99 | 5.54 | 6.59 | −1.05 | −7.1 |
| 432-452 | 6.20 | 7.49 | −1.29 | 6.20 | 7.46 | −1.26 | −7.5 |
| 433-441 | 1.50 | 2.00 | −0.50 | 1.49 | 2.01 | −0.52 | −8.1 |
| 440-452 | 3.95 | 4.81 | −0.86 | 4.03 | 4.80 | −0.77 | −8.3 |
| 442-449 | 2.49 | 2.98 | −0.49 | 2.60 | 2.99 | −0.39 | −8.2 |

TABLE 16

RBD peptides with significant protection upon formation of RBD-mAb10934 complex comparing to RBD alone

| | 5 min incubation | | | 10 min incubation | | | |
|---|---|---|---|---|---|---|---|
| RBD Residues | RBD-mAb10934 D-uptake | RBD D-uptake | ΔD | RBD-mAb10934 D-uptake | RBD D-uptake | ΔD | Δ % D |
| 432-452 | 5.70 | 7.49 | −1.79 | 5.62 | 7.46 | −1.84 | −10.6 |
| 433-441 | 1.60 | 2.00 | −0.40 | 1.63 | 2.01 | −0.38 | −6.2 |
| 434-441 | 2.24 | 2.42 | −0.18 | 2.13 | 2.52 | −0.39 | −5.3 |
| 440-452 | 3.12 | 4.81 | −1.69 | 3.10 | 4.80 | −1.70 | −17.1 |
| 442-449 | 2.37 | 2.98 | −0.61 | 2.37 | 2.99 | −0.62 | −11.4 |
| 442-452 | 2.67 | 4.21 | −1.54 | 2.66 | 4.23 | −1.57 | −19.1 |
| 443-452 | 2.53 | 3.78 | −1.25 | 2.52 | 3.78 | −1.26 | −17.5 |
| 444-451 | 1.79 | 2.73 | −0.94 | 1.80 | 2.73 | −0.93 | −17.2 |
| 444-452 | 1.82 | 3.09 | −1.27 | 1.75 | 3.09 | −1.34 | −20.7 |
| 445-452 | 1.24 | 2.42 | −1.18 | 1.24 | 2.43 | −1.19 | −22.0 |
| 467-474 | 2.64 | 3.16 | −0.52 | 2.58 | 3.17 | −0.59 | −10.2 |
| 470-473 | 0.51 | 0.98 | −0.47 | 0.55 | 0.98 | −0.43 | −25.0 |
| 470-474 | 1.03 | 1.46 | −0.43 | 1.01 | 1.44 | −0.43 | −16.0 |
| 471-474 | 0.56 | 0.89 | −0.33 | 0.55 | 0.89 | −0.34 | −18.6 |
| 480-489 | 3.19 | 3.67 | −0.48 | 3.19 | 3.69 | −0.50 | −6.8 |
| 487-489 | 0.04 | 0.40 | −0.36 | 0.06 | 0.39 | −0.33 | −38.6 |
| 487-490 | 0.54 | 0.90 | −0.36 | 0.53 | 0.84 | −0.31 | −18.8 |
| 487-491 | 0.63 | 1.05 | −0.42 | 0.70 | 1.03 | −0.33 | −20.5 |
| 487-495 | 0.73 | 1.59 | −0.86 | 0.71 | 1.57 | −0.86 | −16.0 |
| 487-509 | 5.55 | 6.99 | −1.44 | 5.57 | 7.02 | −1.45 | −8.9 |
| 487-510 | 5.89 | 7.37 | −1.48 | 6.00 | 7.44 | −1.44 | −8.5 |
| 487-513 | 4.37 | 6.16 | −1.79 | 4.79 | 6.14 | −1.35 | −7.9 |
| 488-509 | 4.50 | 5.49 | −0.99 | 4.60 | 5.52 | −0.92 | −6.2 |
| 488-510 | 5.84 | 6.58 | −0.74 | 5.65 | 6.67 | −1.02 | −5.4 |
| 490-509 | 5.16 | 6.01 | −0.85 | 5.30 | 6.12 | −0.82 | −5.8 |
| 490-512 | 5.15 | 6.37 | −1.22 | 5.30 | 6.28 | −0.98 | −6.4 |
| 490-513 | 4.90 | 6.10 | −1.20 | 5.05 | 6.05 | −1.00 | −6.1 |
| 503-509 | 1.19 | 1.39 | −0.20 | 1.21 | 1.41 | −0.20 | −5.5 |

TABLE 17

| RBD peptides with significant protection upon formation of RBD-mAb10933 complex comparing to RBD alone | | | | | | | |
|---|---|---|---|---|---|---|---|
| | 5 min incubation | | | 10 min incubation | | | |
| RBD Residues | RBD-mAb10933 D-uptake | RBD D-uptake | ΔD | RBD-mAb10933 D-uptake | RBD D-uptake | ΔD | Δ % D |
| 467-474 | 2.52 | 3.16 | −0.64 | 2.55 | 3.17 | −0.62 | −11.7 |
| 470-474 | 1.03 | 1.46 | −0.43 | 1.03 | 1.44 | −0.41 | −15.6 |
| 471-474 | 0.54 | 0.89 | −0.35 | 0.54 | 0.89 | −0.35 | −19.5 |
| 475-487 | 3.62 | 4.50 | −0.88 | 3.63 | 4.48 | −0.85 | −9.6 |
| 475-489 | 3.21 | 4.48 | −1.27 | 3.26 | 4.53 | −1.27 | −11.8 |
| 480-486 | 1.79 | 2.06 | −0.27 | 1.87 | 2.07 | −0.20 | −5.1 |
| 480-489 | 2.13 | 3.67 | −1.54 | 2.18 | 3.69 | −1.51 | −21.2 |
| 483-486 | 0.61 | 0.78 | −0.17 | 0.62 | 0.78 | −0.16 | −9.3 |
| 487-489 | 0.02 | 0.40 | −0.38 | 0.02 | 0.39 | −0.37 | −41.6 |
| 487-490 | 0.42 | 0.90 | −0.48 | 0.40 | 0.84 | −0.44 | −25.6 |
| 487-491 | 0.46 | 1.05 | −0.59 | 0.46 | 1.03 | −0.57 | −32.0 |
| 487-495 | 0.74 | 1.59 | −0.85 | 0.82 | 1.57 | −0.75 | −14.8 |
| 487-509 | 6.01 | 6.99 | −0.98 | 6.14 | 7.02 | −0.88 | −5.7 |
| 487-510 | 6.29 | 7.37 | −1.08 | 6.14 | 7.44 | −1.30 | −7.0 |
| 488-490 | 0.19 | 0.22 | −0.03 | 0.13 | 0.23 | −0.10 | −7.4 |
| 488-491 | 0.26 | 0.37 | −0.11 | 0.25 | 0.36 | −0.11 | −12.3 |

TABLE 18

| RBD peptides with significant protection upon formation of RBD-mAb10920 complex comparing to RBD alone | | | | |
|---|---|---|---|---|
| | 10 min incubation | | | |
| RBD Residues | RBD-mAb10920 D-uptake | RBD D-uptake | ΔD | Δ % Δ |
| 471-486 | 4.63 | 5.40 | −0.77 | −6.6 |
| 475-486 | 2.74 | 3.27 | −0.53 | −6.5 |
| 491-513 | 5.45 | 6.57 | −1.12 | −6.6 |
| 495-510 | 4.51 | 5.43 | −0.92 | −8.5 |
| 495-513 | 4.41 | 5.13 | −0.72 | −5.4 |
| 496-515 | 3.58 | 4.35 | −0.77 | −5.4 |

TABLE 19

| RBD peptides with significant protection upon formation of RBD-mAb10922 complex comparing to RBD alone | | | | |
|---|---|---|---|---|
| | 10 min incubation | | | |
| RBD Residues | RBD-mAb10922 D-uptake | RBD D-uptake | ΔD | Δ % Δ |
| 432-441 | 1.86 | 2.23 | −0.37 | −5.3 |
| 442-452 | 3.52 | 4.57 | −1.05 | −13.0 |

TABLE 20

| RBD peptides with significant protection upon formation of RBD-mAb10936 complex comparing to RBD alone | | | | |
|---|---|---|---|---|
| | 10 min incubation | | | |
| RBD Residues | RBD-mAb10936 D-uptake | RBD D-uptake | ΔD | Δ % Δ |
| 351-360 | 2.68 | 3.10 | −0.42 | −5.9 |
| 432-441 | 1.85 | 2.23 | −0.38 | −5.3 |
| 442-452 | 2.55 | 4.57 | −2.02 | −25.0 |
| 443-452 | 2.98 | 4.01 | −1.03 | −14.2 |

TABLE 20-continued

| RBD peptides with significant protection upon formation of RBD-mAb10936 complex comparing to RBD alone | | | | |
|---|---|---|---|---|
| | 10 min incubation | | | |
| RBD Residues | RBD-mAb10936 D-uptake | RBD D-uptake | ΔD | Δ % Δ |
| 467-470 | 0.69 | 0.84 | −0.15 | −8.1 |
| 471-486 | 4.73 | 5.40 | −0.67 | −5.8 |
| 491-513 | 5.48 | 6.57 | −1.09 | −6.4 |
| 495-510 | 4.38 | 5.43 | −1.05 | −9.8 |

TABLE 21

| RBD peptides with significant protection upon formation of RBD-mAb10954 complex comparing to RBD alone | | | | |
|---|---|---|---|---|
| | 10 min incubation | | | |
| RBD Residues | RBD-mAb10954 D-uptake | RBD D-uptake | ΔD | Δ % Δ |
| 400-420 | 3.67 | 4.56 | −0.89 | −5.5 |
| 401-420 | 3.39 | 4.22 | −0.83 | −5.5 |
| 401-421 | 3.44 | 4.28 | −0.84 | −5.2 |
| 406-420 | 3.32 | 4.10 | −0.78 | −7.2 |
| 406-421 | 3.23 | 4.11 | −0.88 | −7.6 |
| 406-422 | 3.41 | 4.16 | −0.75 | −5.9 |
| 407-420 | 2.86 | 3.62 | −0.76 | −7.7 |
| 407-422 | 2.97 | 3.74 | −0.77 | −6.6 |
| 453-466 | 1.53 | 2.23 | −0.70 | −7.1 |
| 453-470 | 3.63 | 4.53 | −0.90 | −6.7 |
| 453-471 | 4.42 | 5.22 | −0.80 | −5.6 |
| 471-486 | 4.34 | 5.40 | −1.06 | −9.1 |
| 472-486 | 4.47 | 5.29 | −0.82 | −7.6 |
| 490-512 | 5.64 | 6.65 | −1.01 | −5.9 |
| 490-513 | 5.61 | 6.57 | −0.96 | −5.3 |
| 491-513 | 5.26 | 6.57 | −1.31 | −7.7 |
| 493-512 | 4.86 | 5.69 | −0.83 | −5.7 |
| 493-513 | 4.74 | 5.72 | −0.98 | −6.4 |

TABLE 21-continued

RBD peptides with significant protection upon formation of RBD-mAb10954 complex comparing to RBD alone

| RBD Residues | 10 min incubation RBD-mAb10954 D-uptake | RBD D-uptake | ΔD | Δ % Δ |
|---|---|---|---|---|
| 495-510 | 4.77 | 5.43 | −0.66 | −6.2 |
| 495-513 | 4.10 | 5.13 | −1.03 | −7.6 |
| 496-512 | 3.60 | 4.60 | −1.00 | −8.6 |
| 496-515 | 3.43 | 4.35 | −0.92 | −6.4 |

TABLE 22

RBD peptides with significant protection upon formation of RBD-mAb10964 complex comparing to RBD alone

| RBD Residues | 10 min incubation RBD-mAb10964 D-uptake | RBD D-uptake | ΔD | Δ % Δ |
|---|---|---|---|---|
| 401-421 | 3.87 | 4.84 | −0.97 | −6.0 |
| 406-419 | 3.34 | 3.91 | −0.57 | −5.8 |
| 406-420 | 3.47 | 4.15 | −0.68 | −6.3 |
| 406-421 | 3.53 | 4.22 | −0.69 | −5.9 |
| 406-422 | 3.66 | 4.37 | −0.71 | −5.6 |
| 406-424 | 3.31 | 4.24 | −0.93 | −6.5 |
| 410-422 | 3.04 | 3.56 | −0.52 | −5.8 |
| 471-486 | 4.65 | 5.41 | −0.76 | −6.4 |
| 475-489 | 3.34 | 4.56 | −1.22 | −11.3 |
| 480-489 | 2.32 | 3.19 | −0.87 | −12.1 |
| 487-509 | 6.38 | 7.58 | −1.20 | −7.4 |
| 495-513 | 4.50 | 5.20 | −0.70 | −5.2 |
| 496-512 | 4.17 | 4.80 | −0.63 | −5.4 |
| 496-513 | 3.90 | 4.85 | −0.95 | −7.5 |

TABLE 23

RBD peptides with significant protection upon formation of RBD-mAb10977 complex comparing to RBD alone

| RBD Residues | 10 min incubation RBD-mAb10977 D-uptake | RBD D-uptake | ΔD | Δ % Δ |
|---|---|---|---|---|
| 351-364 | 4.82 | 5.38 | −0.56 | −5.2 |
| 471-486 | 3.81 | 5.40 | −1.59 | −13.6 |
| 472-486 | 4.20 | 5.29 | −1.09 | −10.1 |

TABLE 24

RBD peptides with significant protection upon formation of RBD-mAb10984 complex comparing to RBD alone

| RBD Residues | 10 min incubation RBD-mAb10984 D-uptake | RBD D-uptake | ΔD | Δ % Δ |
|---|---|---|---|---|
| 400-420 | 3.73 | 4.56 | −0.83 | −5.2 |
| 401-421 | 3.47 | 4.28 | −0.81 | −5.1 |
| 406-420 | 3.35 | 4.10 | −0.75 | −7.0 |
| 406-421 | 3.31 | 4.11 | −0.80 | −6.9 |
| 406-422 | 3.47 | 4.16 | −0.69 | −5.5 |
| 407-420 | 2.88 | 3.62 | −0.74 | −7.5 |
| 407-422 | 2.94 | 3.74 | −0.80 | −6.8 |

TABLE 24-continued

RBD peptides with significant protection upon formation of RBD-mAb10984 complex comparing to RBD alone

| RBD Residues | 10 min incubation RBD-mAb10984 D-uptake | RBD D-uptake | ΔD | Δ % Δ |
|---|---|---|---|---|
| 453-466 | 1.51 | 2.23 | −0.72 | −7.3 |
| 453-470 | 3.70 | 4.53 | −0.83 | −6.2 |
| 453-471 | 4.49 | 5.22 | −0.73 | −5.1 |
| 471-486 | 4.45 | 5.40 | −0.95 | −8.1 |
| 472-486 | 4.63 | 5.29 | −0.66 | −6.1 |

TABLE 25

RBD peptides with significant protection upon formation of RBD-mAb10986 complex comparing to RBD alone

| RBD Residues | 10 min incubation RBD-mAb10986 D-uptake | RBD D-uptake | ΔD | Δ % Δ |
|---|---|---|---|---|
| 400-420 | 3.58 | 4.56 | −0.98 | −6.1 |
| 400-421 | 3.60 | 4.61 | −1.01 | −5.9 |
| 401-420 | 3.30 | 4.22 | −0.92 | −6.1 |
| 401-421 | 3.29 | 4.28 | −0.99 | −6.1 |
| 401-422 | 3.44 | 4.43 | −0.99 | −5.8 |
| 406-420 | 3.28 | 4.10 | −0.82 | −7.6 |
| 406-421 | 3.24 | 4.11 | −0.87 | −7.5 |
| 406-422 | 3.35 | 4.16 | −0.81 | −6.4 |
| 407-420 | 2.81 | 3.62 | −0.81 | −8.2 |
| 407-422 | 2.91 | 3.74 | −0.83 | −7.1 |
| 453-466 | 1.53 | 2.23 | −0.70 | −7.1 |
| 453-470 | 3.55 | 4.53 | −0.98 | −7.3 |
| 453-471 | 4.41 | 5.22 | −0.81 | −5.6 |
| 471-486 | 4.13 | 5.40 | −1.27 | −10.9 |
| 490-510 | 5.13 | 6.44 | −1.31 | −8.6 |
| 490-512 | 5.33 | 6.65 | −1.32 | −7.7 |
| 490-513 | 5.25 | 6.57 | −1.32 | −7.3 |
| 491-513 | 4.29 | 6.57 | −2.28 | −13.3 |
| 493-512 | 4.46 | 5.69 | −1.23 | −8.5 |
| 493-513 | 4.62 | 5.72 | −1.10 | −7.2 |
| 495-513 | 3.89 | 5.13 | −1.24 | −9.3 |
| 496-513 | 3.36 | 4.53 | −1.17 | −9.3 |
| 496-515 | 3.05 | 4.35 | −1.30 | −9.1 |

Example 12: Identification of Escape Mutants Under Selection Pressure

A study was performed to determine whether selection pressure in the presence of individual anti-SARS-CoV-2 spike glycoprotein antibodies, or combinations of such antibodies, led to generation of escape mutants. Antibodies were serially diluted 1:5 starting at 100 μg/mL in 500 μL of Vesicular Stomatitis Virus media (DMEM high glucose media containing 3% heat-inactivated fetal bovine serum and Penicillin/-Streptomycin-L-Glutamine). A no-antibody control was included to account for any tissue culture variations that may occur. A total of $1.5\times10^6$ plaque forming units (pfu) of replicative VSV-SARS-CoV-2-S virus in 50011.1 of media was added to each dilution and incubated at room temperature for 30 minutes. After the incubation, the mixture was added to $3\times10^5$ Vero E6 cells and incubated for 96 hours at 37° C. with 5% $CO_2$. Virus replication was monitored by screening for cytopathic effect. The supernatants and cellular layers were collected from wells with the highest antibody concentration with evident viral replication. The total RNA, including the viral RNA, was extracted from the cells using TRIzol (Life Technologies) following the manufacturer's protocol for next generation sequencing. For a second round of selection, 100 μL of supernatant containing the virus was brought to 500 μl with VSV media and passed under the same or greater antibody concentrations as before. Again, the supernatants were collected, and RNA was extracted from cells in wells with the highest antibody concentration with evident viral replication.

RNA was quantified using the Qubit RNA HS Assay Kit (ThermoFisher). 1 to 50 ng RNA was treated by FastSelect-rRNA HMR (Qiagen) to remove host rRNA, and the incubation condition for fragmentation was as follows: 85° C. for 6 minutes, 75° C. for 2 minutes, 70° C. for 2 minutes, 65° C. for 2 minutes, 60° C. for 2 minutes, 55° C. for 2 minutes, 37° C. for 5 minutes, 25° C. for 5 minutes, and hold at 4° C. Strand-specific RNA-seq libraries were prepared from the treated RNA using KAPA RNA HyperPrep Kit (Roche Sequencing). UDI with UMI Adapters (IDT) were ligated. Sixteen-cycle PCR was performed to amplify libraries. Sequencing was run on MiSeq (Illumina) by multiplexed paired-read run with 2×70 cycles.

Sequencing analysis was performed using Array Studio software package platform (Omicsoft). Quality of paired-end RNA Illumina reads was assessed using the "raw data QC of RNA-Seq data suite." Minimum and maximum read length, total nucleotide number, and GC % were calculated. Overall quality reports were generated summarizing the quality of all reads in each sample, along with each base pair. Paired-end RNA Illumina reads were then mapped against VSV-SARS-CoV-2-S virus genome using Omicsoft Sequence Aligner (OSA) version 4. Reads were trimmed by quality score using default parameters (when the aligner encountered nucleotide in the read with a quality score of 2 or less, it trimmed the remainder of the read). OSA outputs were analyzed and annotated using Summarize Variant Data and Annotate Variant Data packages (Omicsoft). Target coverage was calculated for each sample. SNP calling was performed using samples with average target coverage greater than 500 reads. SNPs with a minimum frequency of 1% and a coverage greater than 50 were identified and annotated.

Figure 18A:
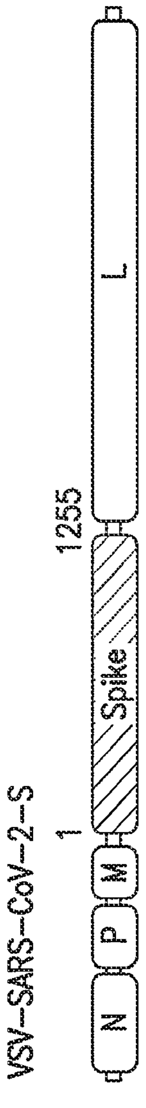
Figure 18B:
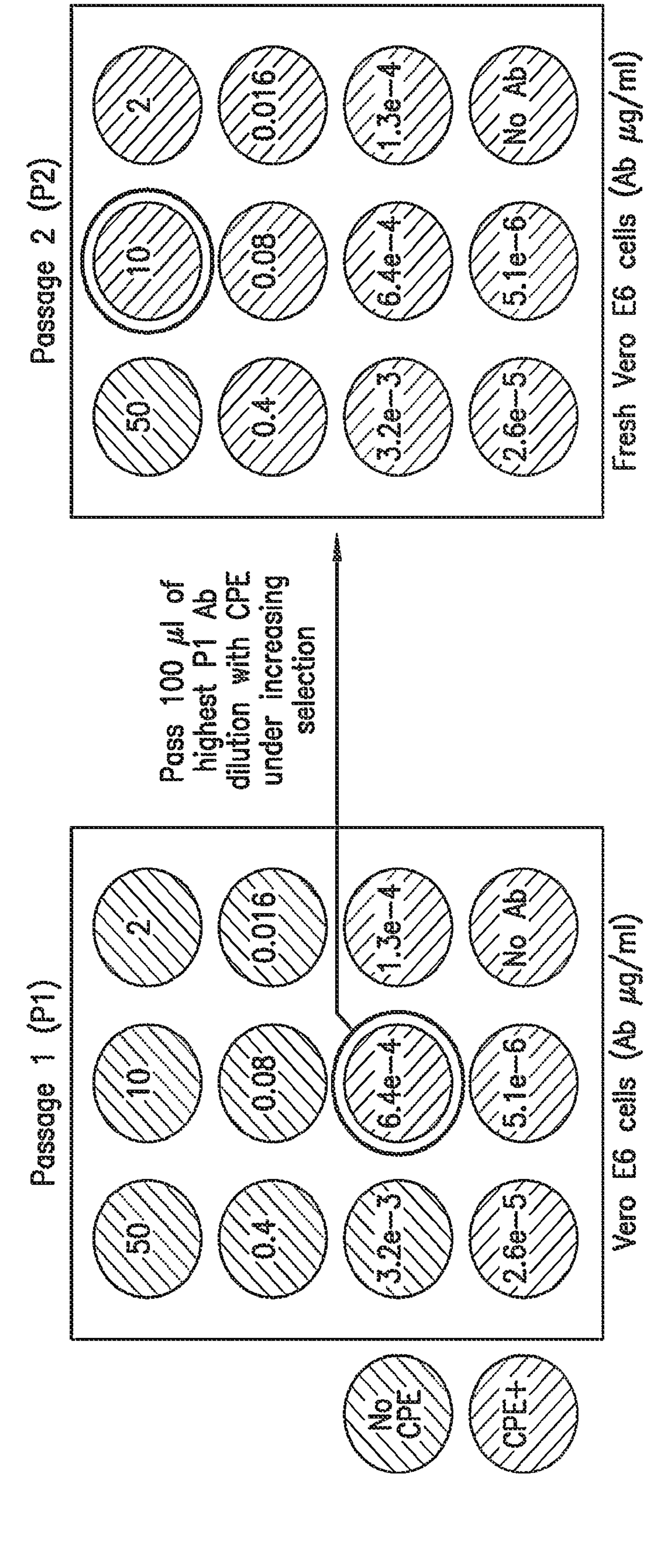
Figure 29A:
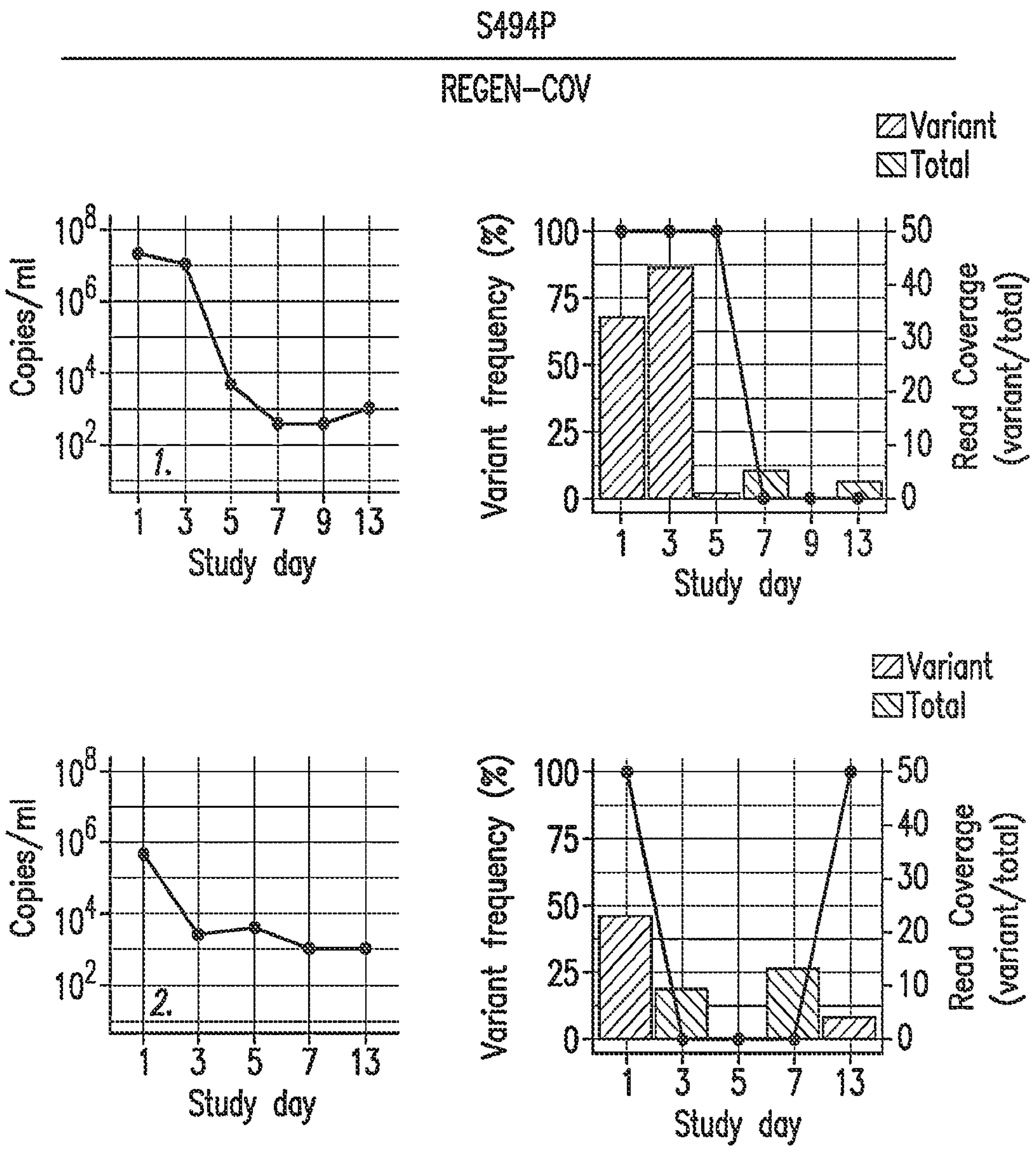
Figures 1, 29B:
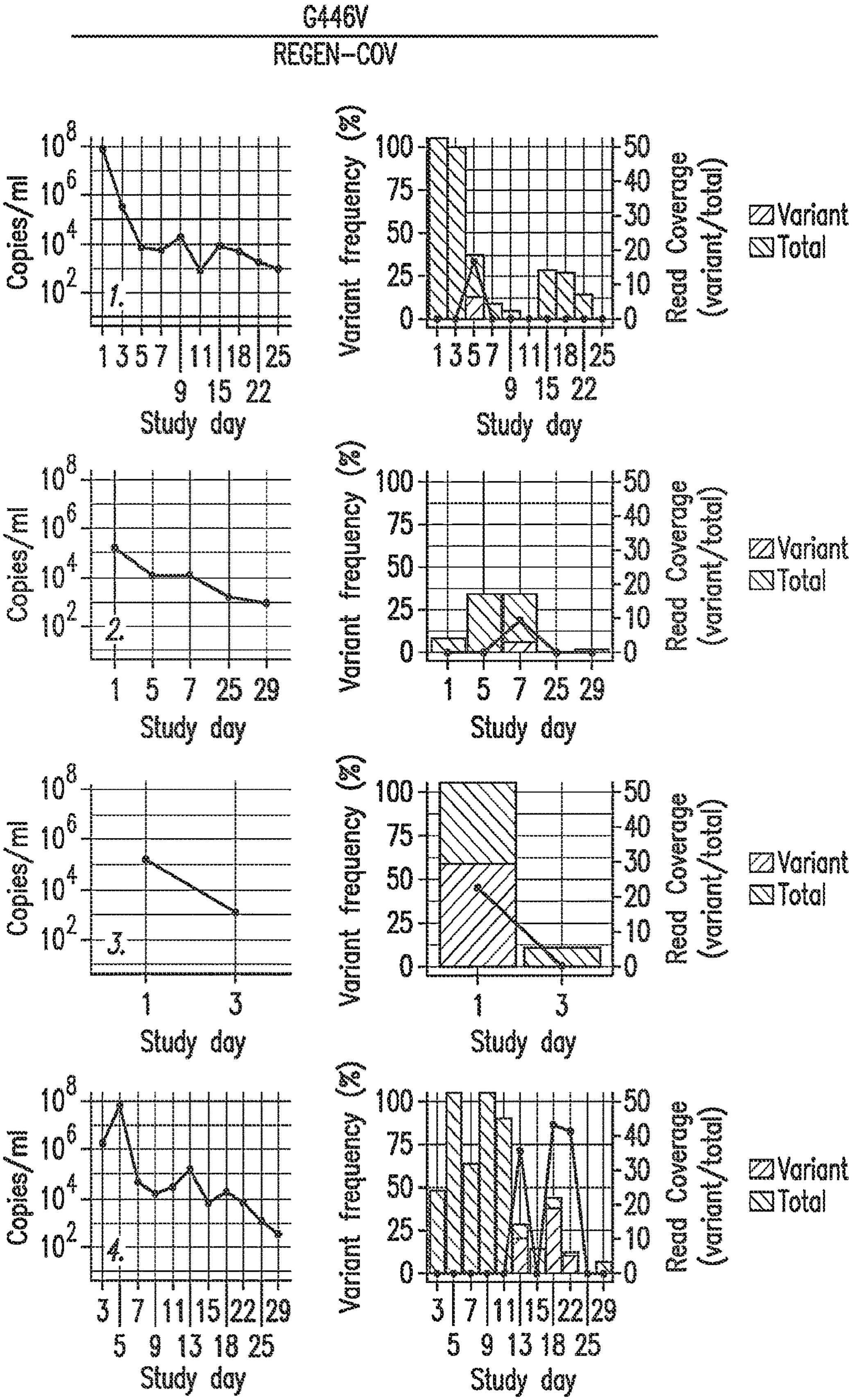
Figures 2, 29B:
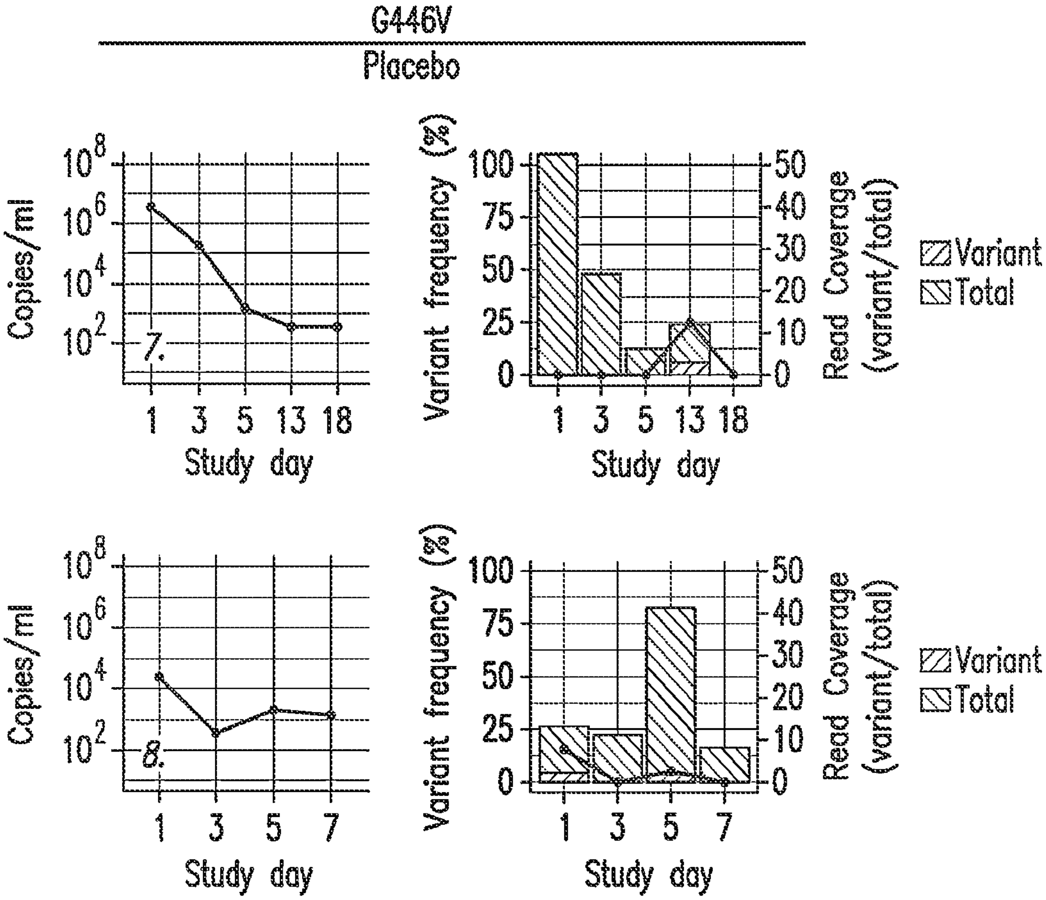

Through the use of the above methods with a replicating VSV-SARS-CoV-2-S virus, escape mutants were selected under pressure of single antibodies, as well as of antibody combinations (FIG. 18A). Multiple independent escape mutants were identified for each of the four individual antibodies within the first passage (FIG. 18B, FIG. 18C, FIG. 19). As shown in FIG. 1, a combination of two non-competing antibodies (mAb10987+mAb10933) prevented selection of escape mutants in SARS-CoV-2 Spike protein. Escape mutants were identified with all four individual antibodies tested in this assay. Some of these mutants became fixed in the population after a single passage and were present in 100% of sequencing reads at antibody concentrations of up to 50 μg/ml (10,000-100,000 greater concentration than IC50). Sequencing of escape mutants (FIG. 19) revealed that single amino acid changes can ablate binding even to antibodies that were selected for breadth against all known RBD variants, and that neutralize parental virus at low pM IC50.

To further analyze the escape mutants observed, 22,872 publicly available unique genome sequences were studied. SARS-CoV-2 complete genome sequences were downloaded from GISAID Nucleotide database (www.gisaid-.org). Sequences were curated and genetic diversity of the spike-encoding gene was assessed across 7,684 high quality genome sequences using custom pipelines. In brief, Blastn was used to align the Wuhan_Hu_1 Spike nucleotide sequence (accession: MN908947) against each individual genome. Results were analyzed and the presence of the gene was validated if alignment length was greater than 95% with an identity percentage greater than 70%. Homologous spike sequences were extracted, translated and aligned to identify amino-acid changes with respect to the reference.

This analysis demonstrated the presence of polymorphisms in two of the escape amino acid residues identified in this study, at an extremely low frequency of one each. Notably, this study included evaluation of both non-competing (mAb10987+mAb10933) and competing (mAb10989+mAb10934) antibodies, but the only condition that did not result in generation of escape mutants was the non-competing antibody combination. Although this study was conducted with a surrogate virus in tissue culture cells, it is expected that similar escape under pressure occurs within the SARS-CoV-2 virus in vivo when only a single antibody is present. Escape against multiple non-competing antibodies requires simultaneous selection of two distinct amino acid mutations that allow the virus to maintain replication fitness, a significantly less likely possibility than selection of a single mutation.

Escape following treatment with the antibody cocktail (mAb10987+mAb10933) was evaluated. This antibody cocktail was designed to avoid escape through inclusion of two antibodies that bind distinct and non-overlapping regions of the RBD, and which can thus simultaneously bind and block RBD function. Attempts to grow VSV-SARS-CoV-2-S virus in the presence of this antibody cocktail did not result in the outgrowth of escape mutants (FIG. 18B, FIG. 18C, FIG. 19, and FIG. 20). Thus, this selected cocktail did not rapidly select for mutants, presumably because escape would require the unlikely occurrence of simultaneous viral mutation at two distinct genetic sites, so as to ablate binding and neutralization by both antibodies in the cocktail.

In addition to the above cocktail, escape following treatment with additional combinations was also evaluated, this time with antibodies that completely or partially compete for binding to the RBD_(mAb10989+mAb10934 and mAb10989+mAb10987), i.e., two antibodies that bind to overlapping regions of the RBD, albeit to different degrees. Under selective pressure of these combination treatments, there was rapid generation of escape mutants resistant to one combination, but not the other (FIG. 18B, FIG. 18C, FIG. 19, and FIG. 20). For the mAb10989+mAb10934 combination, in which the antibodies demonstrate complete competition, a single amino acid substitution was sufficient to ablate neutralization of the cocktail, demonstrating that both of these antibodies require binding to the E484 residue in order to neutralize SARS-CoV-2. Interestingly, such rapid escape did not occur following mAb10989+mAb10987 combination treatment, which only exhibited partial competition; mAb10987 can weakly bind to RBD when mAb10989 is pre-bound. Thus, even a combination of antibodies that are not selected to simultaneously bind may occasionally resist escape because their epitopes only partially overlap, and/or residues that would result in escape are not easily tolerated by the virus, and therefore not readily selected for.

Figure 21:
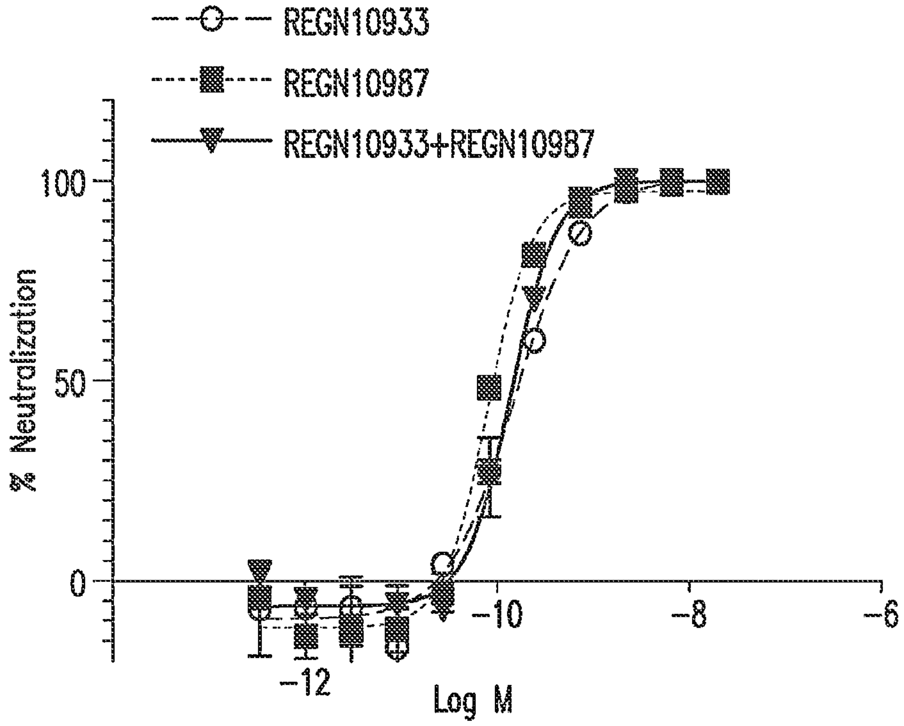
FIG. 21 shows that the combination of mAb10933 and mAb10987 is sufficient to neutralize a VSV expressing the SARS-CoV-2 UK B.1.1.7 variant spike protein.

Furthermore, the combination of mAb10933 and mAb10987 was evaluated for its ability to neutralize pseudotyped VSV expressing a SARS-CoV-2 variant known as B.1.1.7, also called the "UK variant." This variant is rapidly expanding, and may have different effects than wild-type SARS-CoV-2, including more severe symptoms than the wild-type virus and potential resistance to vaccines and/or therapeutics. It is classified, in part, by the following mutations in the spike protein: HV 69-70 deletion, Y144 deletion, N501Y, A570D, P681H, T716I, S982A, and D1118H. mAb10933 and mAb10987, in combination, was shown to neutralize the virus more effectively than either antibody alone (FIG. 21).

| Variant | mAb10933 | mAb10987 | mAb10933 + mAb10987 |
|---|---|---|---|
| | Fold decrease in IC50 from reference SARS-CoV-2 D614G | | |
| UK B.1.1.7 | 0.98 | 0.70 | 1.04 |

Figure 22:
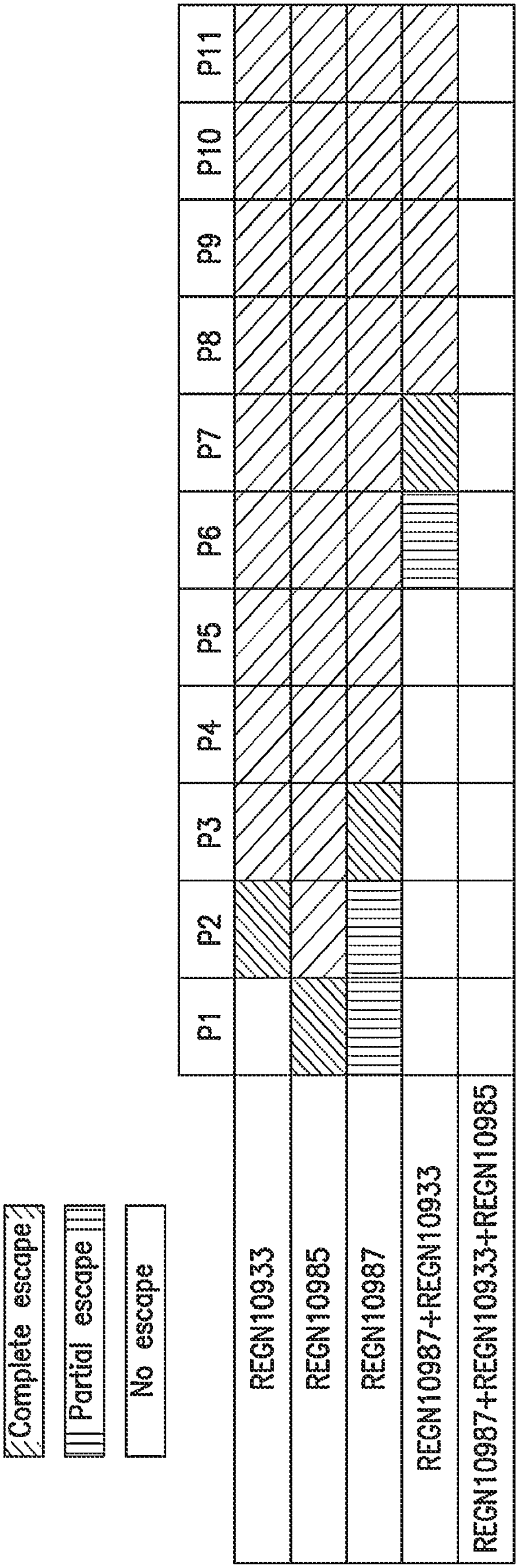

Further experiments were performed to evaluate whether escape occurs in the presence of a three-antibody combination (mAb10933+mAb10987+mAb10985). Complete escape rapidly occurred with each of the three individual antibodies (mAb10933: passage 2; mAb10987: passage 3; mAb10985: passage 1). However, the combination of mAb10933 and mAb10987 extended the generation of complete escape to passage 7, and when mAb10985 was added to the combination of mAb10933 and 10987, no escape was seen even after 11 passages. See FIG. 22.

Example 13: Neutralization of SARS-CoV-2 Wild-Type and Variant Spike Proteins To test whether anti-SARS-CoV-2 spike protein antibodies can neutralize SARS-CoV-2 variants, these antibodies were screened against a panel of VSV pseudotype viruses expressing wild-type and variant spike proteins. VSV pseudotype viruses were generated by transiently transfecting 293T cells with a plasmid encoding the SARS-CoV-2 spike protein or the same plasmid containing nucleotide variations that encode for known variants of the SARS-CoV-2 spike protein amino acid sequence. All plasmids were confirmed by Sanger sequencing. Cells were seeded in 15 cm plates at $1.2\times10^7$ cells per plate in DMEM Complete Media (1000 mL DMEM, Gibco; 100 mL FBS, Gibco; 10 mL PSG, Gibco) one day prior to transfection with μg/plate Spike DNA using 125 μL Lipofectamine LTX, 30 μL PLUS reagent, and up to 3 mL Opti-Mem. 24 hours post transfection, the cells were washed with 10 mL PBS, then infected with an MOI of 0.1 $VSV^{\Delta G:mNeon}$ virus in 10 mL of Opti-Mem. Virus was incubated on cells for 1 hour, with gentle rocking every 10 minutes. Cells were washed 3 times with 10 mL PBS, then overlaid with 20 mL Infection media (1000 mL DMEM, Gibco; 10 mL Sodium Pyruvate, Gibco; 7 mL BSA, Sigma; 5 mL Gentamicin, Gibco) before incubation at 37° C., 5% $CO_2$ for 24 hours. Pseudovirus supernatant was collected into 250 mL centrifuge tubes on ice, then centrifuged at 3000 rpm for 5 minutes to pellet any cellular debris, aliquoted on ice, then frozen to −80° C. Infectivity was tested on Vero cells prior to use in neutralization assays. This material will be referred to as $VSV^{\Delta G:mNeon}$/Spike pseudovirus, or $VSV^{\Delta G:mNeon/Spike}$_(variant amino acid mutation) (for example, $VSV^{\Delta G:mNeon}$/Spike_H49Y).

On Day 1, Vero cells were seeded to 80% confluency in T225 flasks, the cells were washed with PBS (Gibco: 20012-043), TrypLE was added to detach cells from the flask, and Complete DMEM was added to inactivate trypsin. 20,000 Vero cells were plated in in 100 μL of prewarmed Complete DMEM per well in 96 Well Black Polystyrene Microplate (Corning: 3904). On Day 2, $VSV^{\Delta G:mNeon}$/Spike pseudovirus was thawed on ice and diluted with Infection media. Antibodies were diluted in a U-bottom 96 well plate, generating a dilution of each antibody in 210 μl Infection media at 2× assay concentration. 120 μL of diluted antibodies were transferred to a fresh U-bottom plate, and media and an IgG1 control antibody were added to each plate. 120 μl of diluted pseudovirus was added to every well except the media control wells. To those wells, 120 μL of Infection media was added. Pseudovirus with antibodies were incubated for 30 minutes at room temperature, then media was removed from Vero cells. 100 μL of antibody/pseudovirus mixture were added to the cells, and then incubated at 37° C., 5% $CO_2$ for 24 hours. On day 3, supernatant was removed from cell wells and replaced with 100 μL of PBS. Plates were read on a SpectraMax i3 with MiniMax imaging cytometer.

For replicative VSV-SARS-CoV-2-S virus neutralization assays, antibodies were diluted as described above but in VSV media (DMEM high glucose media containing 3% heat-inactivated fetal bovine serum and Penicillin/-Streptomycin-L-Glutamine). An equal volume of media containing 2000 pfu of VSV-SARS-CoV-2-S virus was mixed with the antibody dilutions and incubated for 30 minutes at room temperature. The mixture was then added onto Vero cells and incubated at 37° C., 5% $CO_2$ for 24 hours. The cells were fixed (PBS with 2% paraformaldehyde) for 20 minutes, permeabilized (PBS with 5% fetal bovine serum and 0.1% Triton-X100) for 15 minutes and blocked (PBS with 3% bovine serum albumin) for 1 hour. Infected cells were immunostained with a rabbit anti-VSV serum (Imanis Life Sciences) and an Alexa Fluor® 488 secondary antibody in PBS+3% bovine serum albumin. Fluorescent foci were quantitated using the SpectraMax i3 plate reader with MiniMax imaging cytometer.

In addition to testing neutralization capacity with replicating and non-replicating VSV-SARS-CoV-2-S viruses, antibodies also were tested with SARS-CoV-2 virus. Monoclonal antibodies and antibody combinations were serially diluted in DMEM (Quality Biological), supplemented with 10% (v/v) heat inactivated fetal bovine serum (Sigma), 1% (v/v) penicillin/streptomycin (Gemini Bio-products) and 1% (v/v) L-glutamine (2 mM final concentration, Gibco) (VeroE6 media) to a final volume of 250 μL. Next, 250 μL of VeroE6 media containing SARS-CoV-2 (WA-1) (1000 PFU/mL) was added to each serum dilution and to 250 μL media as an untreated control. The virus-antibody mixtures were incubated for 60 min at 37° C. Following incubation, virus titers of the mixtures were determined by plaque assay. Finally, 50% plaque reduction neutralization titer (PRNT50) values (the serum dilutions at which plaque formation was reduced by 50% relative to that of the untreated control) were calculated using a 4-parameter logistic curve fit to the percent neutralization data (GraphPad Software, La Jolla, CA).

Individual monoclonal antibody half maximal inhibitory concentration (IC50) against VSV-SARS-CoV-2 spike protein (S)-expressing pseudovirus encoding the Wuhan-Hu-1 (NCBI Accession Number MN908947.3) sequence of spike protein (S-wt) were determined in Vero cells (Table 26). The majority of antibodies displayed neutralization potency in the picomolar range (pM), with some exhibiting neutralization potency in nanomolar (nM) range.

While recombinant ACE2 was able to mediate neutralization of the VSV-spike pseudoparticles, as previously reported, its potency was far inferior to that of the monoclonal antibodies, with more than 1000-fold decrease in potency seen relative to the best neutralizing mAbs (FIG.

Figure 11A:
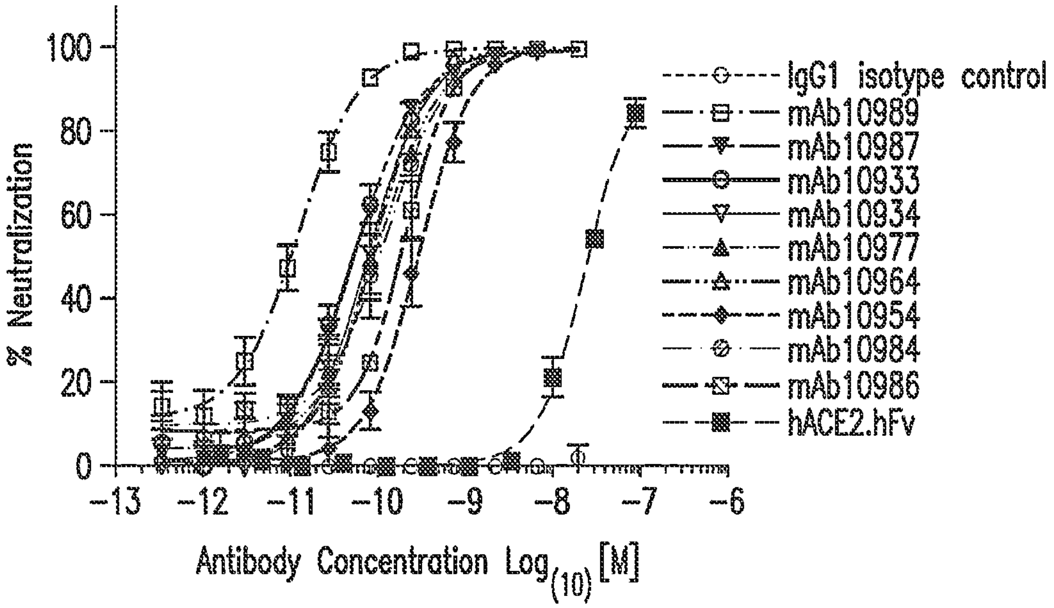
FIG. 11A, FIG. 11B, FIG. 11C and FIG. 11D display the neutralization potency of anti-SARS-CoV-2 Spike mAbs.
Figure 11B:
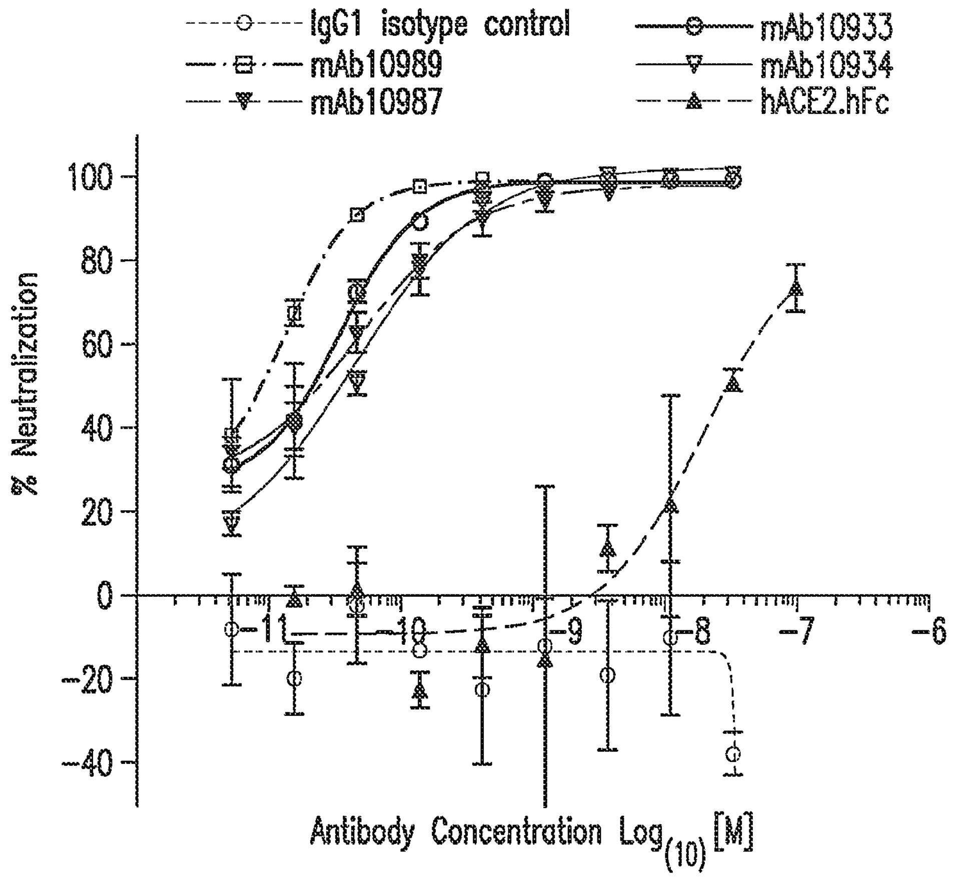
Figure 11C:
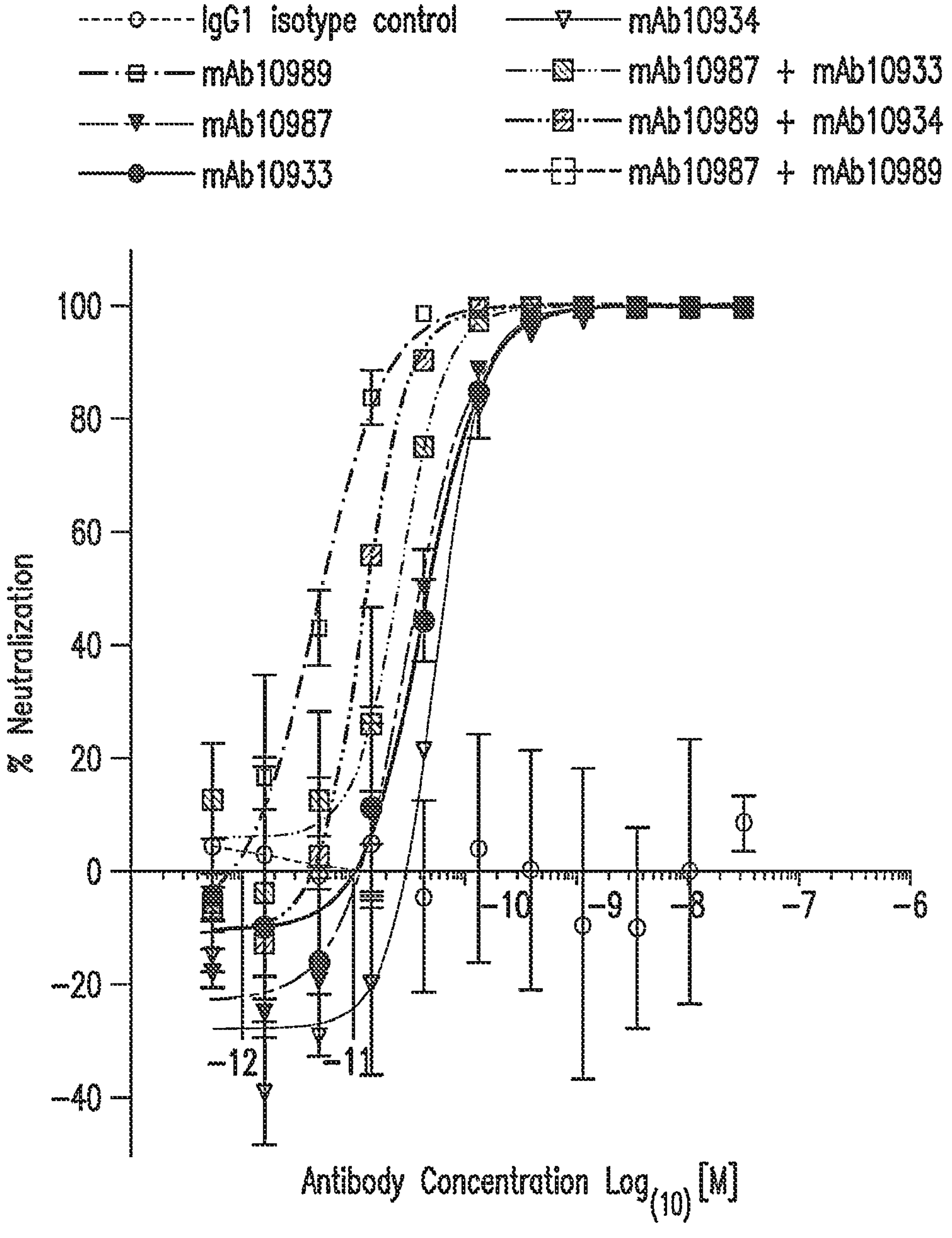
Figure 11D:
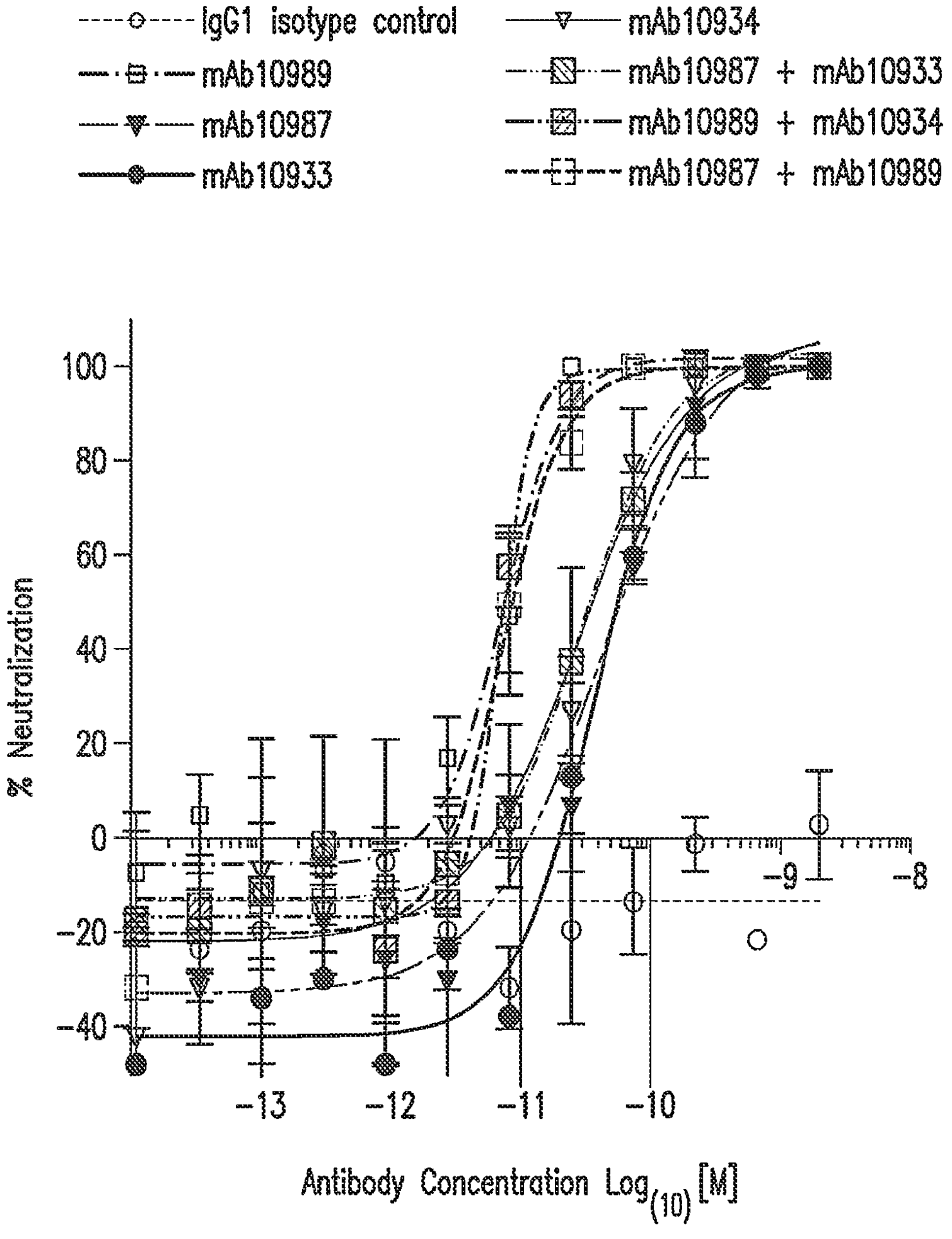

11A and FIG. 11B). In addition, the potent neutralizing activity of mAb10987, mAb10989, mAb10933, and mAb10934 was confirmed in neutralization assays, including pVSV-SARS-CoV-2-S(mNeon) neutralization in the human lung epithelial Calu-3 cell line, neutralization of replicating VSV-SARS-CoV-2-S in Vero cells, and neutralization of SARS-CoV-2 in VeroE6 cells (FIG. 11B, FIG. 11C, and FIG. 11D). All neutralization assays generated similar potency across the four mAbs (mAb10987, mAb10989, mAb10933, and mAb10934) and no combinations demonstrated synergistic neutralization activity (FIG. 11C, FIG. 11D).

TABLE 26 mAb neutralization potency (IC50 (M)) against wild-type strain of VSV-SARS-CoV-2-S pseudoparticles in Vero cells

| Antibody | IC50 (M) |
|---|---|
| mAb10934 | 5.44E−11 |
| mAb10936 | 1.11E−10 |
| mAb10987 | 4.06E−11 |
| mAb10924 | 1.36E−10 |
| mAb10935 | 2.21E−10 |
| mAb10913 | 2.31E−10 |
| mAb10939 | 2.36E−10 |
| mAb10937 | 2.62E−10 |
| mAb10920 | 2.64E−10 |
| mAb10941 | 2.78E−10 |
| mAb10923 | 3.29E−10 |
| mAb10915 | 3.40E−10 |
| mAb10932 | 3.58E−10 |
| mAb10921 | 3.74E−10 |
| mAb10914 | 3.94E−10 |
| mAb10940 | 5.43E−10 |
| mAb10989 | 7.23E−12 |
| mAb10938 | 6.65E−10 |
| mAb10922 | 1.21E−10 |
| mAb10930 | 1.07E−09 |
| mAb10954 | 9.22E−11 |
| mAb10955 | 1.19E−10 |
| mAb10933 | 4.28E−11 |
| mAb10956 | 1.28E−10 |
| mAb10957 | 1.76E−10 |
| mAb10964 | 5.70E−11 |
| mAb10965 | 1.42E−10 |
| mAb10966 | 1.00E−10 |
| mAb10967 | 2.43E−10 |
| mAb10970 | 1.26E−10 |
| mAb10971 | 1.55E−10 |
| mAb10977 | 5.15E−11 |
| mAb10982 | 3.69E−10 |

TABLE 26-continued mAb neutralization potency (IC50 (M)) against wild-type strain of VSV-SARS-CoV-2-S pseudoparticles in Vero cells

| Antibody | IC50 (M) |
|---|---|
| mAb10984 | 9.73E−11 |
| mAb10985 | 2.57E−10 |
| mAb10986 | 9.91E−11 |
| mAb10988 | 2.98E−10 |
| mAb10969 | 2.27E−09 |
| mAb10996 | 1.13E−08 |
| mAb10998 | 9.51E−09 |
| mAb11002 | non−neutralizing |
| mAb11000 | 2.79E−08 |
| mAb11004 | 6.00E−09 |
| mAb11006 | 1.40E−09 |
| mAb11008 | 2.05E−08 |
| mAb11010 | non-neutralizing |

Amino acid variants in spike (S) protein were identified from over 7000 publicly available SARS-CoV-2 sequences, representing globally circulating isolates, and cloned into VSV pseudoparticles. Neutralization assays with variant-encoding pseudoparticles were performed to assess the impact of each variant on neutralization potency of the monoclonal antibodies. Table 27 illustrates the relative neutralization potency of monoclonal antibodies against variant encoding pseudoparticles relative to SARS-CoV-2 spike (S-wt) at a single concentration of 5 μg/ml. Percent of neutralization relative to S-wt was captured for each individual antibody and variant. None of the antibodies demonstrated loss of neutralization potency at the 5 μg/ml concentration with the exception of mAb10985 and the R4081 variant. These data demonstrate broad functional neutralization coverage of monoclonal antibodies against globally circulating SARS-CoV-2 spike variants.

To further interrogate the impact of the S protein variants on neutralization potency of the monoclonal antibodies, full neutralization curves were run to determine the IC50 value of the most potent neutralizing antibodies against a subset of variants localized within the receptor binding domain (RBD) of the S protein. Table 28 shows the IC50 neutralization values for each variant psuedoparticle. Intrinsic variability of up to 3-fold can be observed between pseudoparticle neutralization assays and does not indicate a change in neutralization potency. These data demonstrate that the antibodies retained their neutralization potency against a diverse panel of S protein RBD variants.

TABLE 27

Relative neutralization of VSV-SARS-COV-2 variants encoding S protein at 5 μg/ml antibody concentration in Vero cells

| mAb | wt | H49Y | S50L | V341I | N354D | S359N | V367F | K378R |
|---|---|---|---|---|---|---|---|---|
| mAb10989 | 100% | 100% | 88% | 100% | 100% | 99% | 100% | 100% |
| mAb10987 | 100% | 100% | 96% | 99% | 100% | 99% | 100% | 100% |
| mAb10933 | 100% | 100% | 96% | 99% | 100% | 99% | 100% | 99% |
| mAb10977 | 100% | 100% | 98% | 100% | 99% | 100% | 100% | 100% |
| mAb10934 | 100% | 100% | 95% | 100% | 100% | 99% | 100% | 99% |
| mAb10964 | 100% | 100% | 90% | 100% | 99% | 99% | 100% | 100% |
| mAb10954 | 100% | 100% | 92% | 100% | 100% | 99% | 100% | 100% |
| mAb10984 | 100% | 100% | 95% | 100% | 99% | 99% | 100% | 99% |
| mAb10986 | 100% | 100% | 98% | 100% | 99% | 99% | 100% | 100% |
| mAb10966 | 100% | 100% | 90% | 100% | 99% | 99% | 100% | 100% |
| mAb10936 | 100% | 100% | 96% | 100% | 99% | 99% | 100% | 100% |
| mAb10955 | 100% | 100% | 95% | 99% | 99% | 99% | 100% | 100% |
| mAb10922 | 100% | 100% | 98% | 99% | 99% | 99% | 100% | 99% |
| mAb10970 | 100% | 100% | 99% | 100% | 100% | 100% | 100% | 99% |
| mAb10956 | 100% | 100% | 96% | 99% | 99% | 99% | 100% | 100% |
| mAb10924 | 100% | 100% | 96% | 100% | 99% | 99% | 100% | 99% |

TABLE 27-continued

Relative neutralization of VSV-SARS-COV-2 variants encoding S protein at 5 μg/ml antibody concentration in Vero cells

| | | | | | | | | |
|---|---|---|---|---|---|---|---|---|
| mAb10965 | 100% | 100% | 96% | 100% | 99% | 100% | 100% | 100% |
| mAb10971 | 100% | 100% | 90% | 99% | 99% | 99% | 100% | 99% |
| mAb10957 | 100% | 100% | 91% | 99% | 99% | 98% | 100% | 99% |
| mAb10935 | 100% | NR | NR | NR | NR | 99% | NR | 99% |
| mAb10913 | 100% | 100% | 93% | 100% | 99% | 98% | 100% | 99% |
| mAb10939 | 100% | 100% | 93% | 98% | 99% | 100% | 100% | 99% |
| mAb10967 | 100% | 100% | 90% | 99% | 99% | 98% | 100% | 100% |
| mAb10985 | 100% | 100% | 96% | 99% | 99% | 98% | 100% | 99% |
| mAb10937 | 100% | 100% | 92% | 99% | 100% | 98% | 100% | 99% |
| mAb10920 | 100% | 100% | 92% | 99% | 99% | 99% | 100% | 99% |
| mAb10941 | 100% | 99% | 97% | 99% | 100% | 99% | 100% | 100% |
| mAb10988 | 100% | 100% | 99% | 100% | 99% | 98% | 100% | 100% |
| mAb10923 | 100% | 101% | 102% | 97% | 103% | 105% | 104% | 103% |
| mAb10915 | 100% | 100% | 95% | 100% | 99% | 99% | 100% | 99% |
| mAb10932 | 100% | 100% | 93% | 100% | 99% | 99% | 100% | 99% |
| mAb10982 | 100% | 100% | 94% | 99% | 99% | 99% | 100% | 100% |

| mAb | R408I | Q409E | A435S | K458R | G476S | Y483A | Y508H | H519P | |
|---|---|---|---|---|---|---|---|---|---|
| mAb10989 | 100% | 101% | 100% | 99% | 99% | 100% | 100% | 97% | 100% |
| mAb10987 | 99% | 100% | 100% | 99% | 99% | 99% | 100% | 97% | 100% |
| mAb10933 | 100% | 99% | 100% | 99% | 99% | 100% | 100% | 98% | 100% |
| mAb10977 | 100% | 100% | 99% | 99% | 99% | 99% | 100% | 97% | 100% |
| mAb10934 | 100% | 100% | 100% | 98% | 98% | 99% | 100% | 97% | 100% |
| mAb10964 | 99% | 100% | 99% | 98% | 100% | 99% | 100% | 96% | 100% |
| mAb10954 | 100% | 100% | 100% | 100% | 100% | 100% | 100% | 97% | 100% |
| mAb10984 | 99% | 100% | 100% | 99% | 99% | 100% | 100% | 96% | 100% |
| mAb10986 | 100% | 100% | 100% | 98% | 99% | 100% | 100% | 99% | 100% |
| mAb10966 | 99% | 100% | 100% | 99% | 100% | 99% | 100% | 96% | 100% |
| mAb10936 | 99% | 100% | 100% | 99% | 99% | 99% | 100% | 97% | 100% |
| mAb10955 | 100% | 100% | 99% | 99% | 99% | 99% | 100% | 97% | 100% |
| mAb10922 | 99% | 100% | 100% | 98% | 99% | 99% | 100% | 97% | 99% |
| mAb10970 | 100% | 101% | 100% | 100% | 99% | 99% | 100% | 99% | 100% |
| mAb10956 | 100% | 100% | 99% | 99% | 100% | 99% | 100% | 97% | 100% |
| mAb10924 | 99% | 100% | 100% | 99% | 99% | 99% | 99% | 98% | 100% |
| mAb10965 | 99% | 100% | 100% | 99% | 100% | 99% | 100% | 98% | 100% |
| mAb10971 | 99% | 100% | 100% | 99% | 99% | 99% | 100% | 98% | 100% |
| mAb10957 | 99% | 100% | 99% | 98% | 99% | 99% | 100% | 98% | 100% |
| mAb10935 | NR | NR | NR | NR | 98% | NR | 99% | NR | NR |
| mAb10913 | 99% | 100% | 100% | 99% | 98% | 99% | 99% | 97% | 100% |
| mAb10939 | 99% | 100% | 99% | 98% | 97% | 98% | 100% | 96% | 100% |
| mAb10967 | 99% | 99% | 99% | 98% | 99% | 98% | 100% | 97% | 100% |
| mAb10985 | 26% | 100% | 100% | 99% | 99% | 100% | 99% | 97% | 99% |
| mAb10937 | 100% | 99% | 99% | 99% | 99% | 100% | 99% | 98% | 100% |
| mAb10920 | 99% | 100% | 100% | 99% | 98% | 100% | 99% | 98% | 100% |
| mAb10941 | 99% | 100% | 100% | 98% | 98% | 98% | 100% | 96% | 100% |
| mAb10988 | 100% | 101% | 99% | 99% | 99% | 100% | 99% | 98% | 100% |
| mAb10923 | 103% | 104% | 100% | 100% | 96% | 98% | 101% | 97% | 101% |
| mAb10915 | 98% | 100% | 100% | 98% | 97% | 100% | 99% | 97% | 100% |
| mAb10932 | 99% | 100% | 99% | 99% | 98% | 100% | 99% | 98% | 100% |
| mAb10982 | 99% | 100% | 99% | 98% | 99% | 99% | 100% | 98% | 100% |

TABLE 28

Neutralization IC50 (M) of VSV-SARS-COV-2-S RBD variants in Vero cells

| | Q321S | V341I | A348T | N354D | S359N | V376F | K378S | R408I |
|---|---|---|---|---|---|---|---|---|
| mAb10933 | 6.85E−11 | 3.37E−11 | 4.13E−11 | 5.89E−11 | 2.12E−11 | 2.40E−11 | 3.52E−11 | 1.98E−11 |
| mAb10934 | 6.84E−11 | 7.42E−11 | 1.42E−10 | 9.76E−11 | 3.04E−11 | 3.20E−11 | 4.65E−11 | 2.75E−11 |
| mAb10984 | 2.75E−10 | 2.49E−10 | 2.01E−10 | 2.64E−10 | 1.23E−10 | 1.53E−10 | 1.88E−10 | 1.35E−10 |
| mAb10986 | 2.06E−10 | 1.92E−10 | 1.03E−10 | 2.49E−10 | 8.91E−11 | 1.49E−10 | 1.54E−10 | 6.14E−11 |
| mAb10987 | 5.02E−11 | 3.38E−11 | 2.98E−11 | 2.68E−11 | 2.41E−11 | 1.78E−11 | 2.40E−11 | 1.71E−11 |
| mAb10989 | 1.46E−11 | 1.61E−11 | 7.33E−12 | 1.14E−11 | 4.30E−12 | 1.33E−11 | 1.21E−11 | 1.09E−11 |
| mAb10964 | 5.65E−11 | 1.13E−10 | 3.52E−11 | 1.93E−10 | 6.83E−11 | 8.92E−11 | 6.19E−11 | 4.96E−11 |
| mAb10954 | 2.32E−10 | 2.52E−10 | 1.84E−10 | 2.84E−10 | 1.09E−10 | 1.29E−10 | 1.65E−10 | 9.88E−11 |
| IgG1 Isotype Control | N/A | N/A | N/A | N/A | N/A | N/A | N/A | N/A |

| | Q409E | A435S | K458R | I472V | G476S | V483A | Y508H | H519P |
|---|---|---|---|---|---|---|---|---|
| mAb10933 | 5.65E−11 | 4.71E−11 | 3.43E−11 | 9.17E−11 | 1.41E−10 | 1.54E−11 | 4.77E−11 | 3.03E−11 |
| mAb10934 | 5.94E−11 | 8.07E−11 | 3.46E−11 | 9.40E−11 | 3.51E−11 | 4.43E−11 | 6.73E−11 | 3.56E−11 |

TABLE 28-continued

| Neutralization IC50 (M) of VSV-SARS-COV-2-S RBD variants in Vero cells | | | | | | | | |
|---|---|---|---|---|---|---|---|---|
| mAb10984 | 1.52E−10 | 2.18E−10 | 1.59E−10 | 2.61E−10 | 2.10E−10 | 1.71E−10 | 2.83E−10 | 1.08E−10 |
| mAb10986 | 1.95E−10 | 1.51E−10 | 1.00E−10 | 2.24E−10 | 1.13E−10 | 9.70E−11 | 2.01E−10 | 6.14E−11 |
| mAb10987 | 4.06E−11 | 3.88E−11 | 1.68E−11 | 4.18E−11 | 1.86E−11 | 2.60E−11 | 2.75E−11 | 2.20E−11 |
| mAb10989 | 2.12E−11 | 1.10E−11 | 7.51E−12 | 2.27E−11 | 6.80E−12 | 8.78E−12 | 1.71E−11 | 4.51E−12 |
| mAb10964 | 6.61E−11 | 7.90E−11 | 5.46E−11 | 1.01E−10 | 3.42E−11 | 4.50E−11 | 1.02E−10 | 4.45E−11 |
| mAb10954 | 2.64E−10 | 2.11E−10 | 1.45E−10 | 3.44E−10 | 1.83E−10 | 1.12E−10 | 2.05E−10 | 1.40E−10 |
| IgG1 Isotype Control | N/A | N/A | N/A | N/A | N/A | N/A | N/A | N/A |

Non-clinical studies using serial passage of recombinant vesicular stomatitis virus (VSV) encoding SARS-CoV-2 spike protein with each of the individual antibodies in a mAb10933-mAb10987 combination identified spike protein mutants with reduced susceptibility to their respective individual antibody by greater than 15-fold (mAb10933 monotherapy identified K417E, K417R, K417N, Y453F, L455F, F486V, and Q493K substitutions in the spike protein receptor binding domain, while mAb10987 monotherapy identified substitutions K444N, K444Q, K444T, and V445A in the spike receptor binding domain). These variants were identified within a single passage and some were fixed in the virus population by the second passage. None of these variants, selected via passage in the presence of the individual antibodies, had reduced susceptibility to the REGN-COV2 two antibody cocktail. Moreover, passaging in the presence of REGN-COV2 two antibody cocktail did not identify any resistant substitutions after the same number of passages.

Genotypic and phenotypic testing can be used monitor for potential REGN-COV2-resistance-associated spike variants in clinical trials. No known resistance variants to the mAb10933 antibody were observed in 288 samples sequenced from a Phase I study among 66 patients that were analyzed. The G446V variant, which has reduced susceptibility to neutralization by mAb10987 (about 135-fold reduction in neutralization IC50) was identified in 3 out of 288 analyzed samples at >15% allele frequency: two baseline samples (one in the placebo and one the 2400 mg arms of the study, but not in subsequence samples from the same individuals) and one day 25 sample in the 8000 mg arm of the study (4 sequencing reads out of 1,292 total reads in the sample). The G446V variant remains susceptible to neutralization by the mAb10933-mAb10987 two-antibody cocktail, and no variants resistant to the mAb10933-mAb10987 two-antibody cocktail were identified in any clinical samples, either at baseline or after treatment. These results have not yet been correlated to a clinical relevance.

Example 14: Biacore Binding Kinetics of Purified Anti-SARS-CoV-2-S Monoclonal Antibodies Equilibrium dissociation constant ($K_D$) for different SARS-CoV-2 RBD reagents binding to purified CHOt anti-SARS-CoV-2 monoclonal antibodies (mAbs) were determined using a real-time surface plasmon resonance based Biacore T200/Biacore 8K biosensor. All binding studies were performed in 10 mM HEPES, 150 mM NaCl, 3 mM EDTA, and 0.05% v/v Surfactant Tween-20, pH 7.4 (HBS-ET) running buffer at 25° C. and 37° C. The Biacore CM5 sensor chip surface was first derivatized by amine coupling with either mouse anti-human Fc specific mAb (Regeneron, mAb2567) to capture anti-SARS-CoV-2bmAbs. Binding studies were performed on human SARS-CoV-2 RBD extracellular domain expressed with a C-terminal myc-myc-hexahistidine (SARS-CoV-2 SARS-CoV-2 RBD extracellular domain expressed with a C-terminal mouse IgG2a (SARS-CoV-2 RBD-mFc), and SARS-CoV-2 Spike ecto foldon Trimer expressed with a C-terminal myc-myc-hexahistidine (SARS-CoV-2 Spike ECD foldon). Use of these reagents allowed for the testing of the antibodies' ability to bind monomeric, dimeric, and trimeric RBD peptides, respectively. The amino acid sequence of the SARS-CoV-2 Spike ECD foldon is as follows (Spike ecto: amino acids 1-1198; Fold on trimer: amino acids 1199-1225; GS: amino acids 1226-1227; thrombin: amino acids 1228-1233; myc-myc-hexahistidine tag: 1234-1261):

QCVNLTTRTQLPPAYTNSFTRGVYYPDKVFRSSVLHSTQDLFLPFFSNVTWFHAIHVSGT

NGTKRFDNPVLPFNDGVYFASTEKSNIIRGWIFGTTLDSKTQSLLIVNNATNVVIKVCEF

QFCNDPFLGVYYHKNNKSWMESEFRVYSSANNCTFEYVSQPFLMDLEGKQGNFKNLRE

FVFKNIDGYFKIYSKHTPINLVRDLPQGFSALEPLVDLPIGINITRFQTLLALHRSYLTPGD

SSSGWTAGAAAYYVGYLQPRTFLLKYNENGTITDAVDCALDPLSETKCTLKSFTVEKGI

YQTSNFRVQPTESIVRFPNITNLCPFGEVFNATRFASVYAWNRKRISNCVADYSVLYNSA

SFSTFKCYGVSPTKLNDLCFTNVYADSFVIRGDEVRQIAPGQTGKIADYNYKLPDDFTGC

VIAWNSNNLDSKVGGNYNYLYRLFRKSNLKPFERDISTEIYQAGSTPCNGVEGFNCYFP

LQSYGFQPTNGVGYQPYRVVVLSFELLHAPATVCGPKKSTNLVKNKCVNFNFNGLTGT

GVLTESNKKFLPFQQFGRDIADTTDAVRDPQTLEILDITPCSFGGVSVITPGTNTSNQVAV

LYQDVNCTEVPVAIHADQLTPTWRVYSTGSNVFQTRAGCLIGAEHVNNSYECDIPIGAGI

CASYQTQTNSPGSASSVASQSIIAYTMSLGAENSVAYSNNSIAIPTNFTISVTTEILPVSMT

-continued

KTSVDCTMYICGDSTECSNLLLQYGSFCTQLNRALTGIAVEQDKNTQEVFAQVKQIYKT

PPIKDFGGFNFSQILPDPSKPSKRSFIEDLLFNKVTLADAGFIKQYGDCLGDIAARDLICAQ

KFNGLTVLPPLLTDEMIAQYTSALLAGTITSGWTFGAGAALQIPFAMQMAYRENGIGVT

QNVLYENQKLIANQFNSAIGKIQDSLSSTASALGKLQDVVNQNAQALNTLVKQLSSNFG

AISSVLNDILSRLDPPEAEVQIDRLITGRLQSLQTYVTQQLIRAAEIRASANLAATKMSEC

VLGQSKRVDFCGKGYHLMSFPQSAPHGVVFLHVTYVPAQEKNFTTAPAICHDGKAHFP

REGVFVSNGTHWFVTQRNFYEPQIITTDNTFVSGNCDVVIGIVNNTVYDPLQPELDSFKE

ELDKYFKNHTSPDVDLGDISGINASVVNIQKEIDRLNEVAKNLNESLIDLQELGKYEQYI

KGYIPEAPRDGQAYVRKDGEWVLLSTFLGSLVPRGSEQKLISEEDLGGEQKLISEEDLHH

HHHH

Different concentrations of hSARS-CoV-2 RBD-MMH, (90 nM-3.33 nM, 3-fold dilution), SARS-CoV-2 RBD-mFc (30 nM-1.11 nM 3-fold dilution), and SARS-CoV2 Spike ECD foldon (0.78 nM-25 nM, three-fold serial dilution) prepared in HBS-ET running buffer, were injected for 3 minutes at a flow rate of 50 μL/min while the dissociation of mAb bound different SARS-CoV-2 RBD reagents was monitored for 6-10 minutes in HBS-ET running buffer. At the end of each cycle, the SARS-CoV-2 RBD mAb capture surface was regenerated using either 12 sec injection of 20 mM phosphoric acid for mouse anti-human Fc specific mAb surface. The association rate ($k_a$) and dissociation rate ($k_d$) were determined by fitting the real-time binding sensorgrams to a 1:1 binding model with mass transport limitation using BiaEvaluation software v3.1 or Biacore Insight Evaluation software v2.0. or curve-fitting software. Binding dissociation equilibrium constant ($K_D$) and dissociative half-life ($t_{1/2}$) were calculated from the kinetic rates as:

$$K_D(M) = \frac{kd}{ka},$$

and $$t\frac{1}{2}\ (\text{min}) = \frac{\ln(2)}{60 * kd}$$

Binding kinetics parameters for different SARS-CoV-2 mAbs binding to different anti-SARS-CoV-2 RBD reagents of the invention at 25° C. and 37° C. are shown in Tables 29 through 34, respectively.

TABLE 29

Binding kinetics parameters of SARS-COV-2 RBD-MMH binding to anti-SARS-COV-2-S monoclonal antibodies at 25° C.

| mAb Captured (mAb#) | mAb Capture Level (RU) | 90 nM Ag Bound (RU) | $k_a$ (1/Ms) | $k_d$ (1/s) | KD (M) | t½ (min) |
|---|---|---|---|---|---|---|
| mAb10913 | 287 ± 3 | 55.9 | 4.04E+05 | 2.12E−02 | 5.26E−08 | 0.5 |
| mAb10914 | 310 ± 2 | 51.1 | 8.81E+04 | 3.76E−03 | 4.26E−08 | 3.1 |
| mAb10915 | 310 ± 2 | 63.2 | 9.61E+04 | 1.08E−04 | 1.13E−09 | 106.9 |
| mAb10920 | 307 ± 3 | 73.9 | 4.52E+05 | 1.30E−02 | 2.87E−08 | 0.9 |
| mAb10921 | 307 ± 3 | 61.4 | 1.01E+05 | 4.75E−04 | 4.71E−09 | 24.3 |
| mAb10922 | 312.2 ± 1.7 | 120.2 | 6.14E+05 | 1.48E−03 | 2.41E−09 | 7.8 |
| mAb10923 | 283 ± 2 | 80.4 | 4.66E+05 | 6.17E−03 | 1.32E−08 | 1.9 |
| mAb10924 | 319 ± 2 | 94.6 | 2.07E+05 | 1.74E−03 | 8.40E−09 | 6.6 |
| mAb10930 | 284.7 ± 0.7 | 59.6 | 1.24E+05 | 3.34E−03 | 2.70E−08 | 3.5 |
| mAb10932 | 315 ± 3 | 79.4 | 8.99E+04 | 1.21E−04 | 1.35E−09 | 95.5 |
| mAb10933 | 280 ± 1 | 99.8 | 1.52E+06 | 2.78E−03 | 1.83E−09 | 4.2 |
| mAb10934 | 280 ± 1 | 103.4 | 4.82E+06 | 5.77E−03 | 1.20E−09 | 2.0 |
| mAb10935 | 337 ± 2 | 107.8 | 3.93E+05 | 4.19E−03 | 1.07E−08 | 2.8 |
| mAb10936 | 311 ± 2 | 107.3 | 5.45E+05 | 1.07E−03 | 1.97E−09 | 10.8 |
| mAb10937 | 311 ± 2 | 102.2 | 5.72E+05 | 4.76E−03 | 8.34E−09 | 2.4 |
| mAb10938 | 338 ± 3 | 61.5 | 7.27E+04 | 1.75E−04 | 2.41E−09 | 66.0 |
| mAb10939 | 343 ± 2 | 82.3 | 1.63E+05 | 2.84E−03 | 1.74E−08 | 4.1 |
| mAb10940 | 338 ± 3 | 103.5 | 8.01E+05 | 2.51E−03 | 3.13E−09 | 4.6 |
| mAb10941 | 327 ± 1 | 92.1 | 1.20E+05 | 4.12E−04 | 3.43E−09 | 28.0 |
| mAb10954 | 286.9 ± 3 | 110.5 | 4.04E+05 | 3.64E−04 | 8.99E−10 | 31.7 |
| mAb10955 | 298.3 ± 2.5 | 88.8 | 1.61E+05 | 2.12E−03 | 1.32E−08 | 5.4 |
| mAb10956 | 293.7 ± 0.6 | 86.6 | 2.22E+05 | 4.06E−03 | 1.82E−08 | 2.8 |
| mAb10957 | 286.7 ± 2 | 93.0 | 1.38E+05 | 2.53E−04 | 1.84E−09 | 45.7 |
| mAb10964 | 259.6 ± 1.2 | 99.9 | 1.65E+06 | 3.90E−04 | 2.36E−10 | 29.6 |
| mAb10965 | 253.1 ± 1.9 | 63.6 | 1.24E+05 | 2.92E−03 | 2.35E−08 | 4.0 |
| mAb10966 | 266.6 ± 3 | 97.4 | 2.37E+05 | 3.65E−04 | 1.54E−09 | 31.6 |

TABLE 29-continued

Binding kinetics parameters of SARS-COV-2 RBD-MMH binding to anti-SARS-COV-2-S monoclonal antibodies at 25° C.

| mAb Captured (mAb#) | mAb Capture Level (RU) | 90 nM Ag Bound (RU) | $k_a$ (1/Ms) | $k_d$ (1/s) | KD (M) | t½ (min) |
|---|---|---|---|---|---|---|
| mAb10967 | 260.2 ± 0.9 | 70.7 | 1.24E+05 | 6.28E−05 | 5.08E−10 | 183.9 |
| mAb10969 | 272.2 ± 1.3 | 87.1 | 2.45E+05 | 3.80E−03 | 1.55E−08 | 3.0 |
| mAb10970 | 307.3 ± 1.3 | 102.8 | 2.27E+05 | 1.10E−03 | 4.85E−09 | 10.5 |
| mAb10971 | 263.1 ± 1.1 | 89.3 | 2.15E+05 | 3.75E−04 | 1.74E−09 | 30.8 |
| mAb10977 | 305 ± 3 | 98.5 | 2.43E+05 | 2.57E−04 | 1.06E−09 | 44.9 |
| mAb10982 | 267.8 ± 0.5 | 69.3 | 1.23E+05 | 2.06E−03 | 1.68E−08 | 5.6 |
| mAb10984 | 334 ± 2.1 | 117.9 | 2.04E+05 | 4.26E−04 | 2.09E−09 | 27.1 |
| mAb10985 | 306.9 ± 2.1 | 113.4 | 1.44E+06 | 1.55E−03 | 1.08E−09 | 7.5 |
| mAb10986 | 268.8 ± 0.9 | 104.3 | 4.64E+05 | 1.49E−04 | 3.21E−10 | 77.5 |
| mAb10987 | 270.8 ± 1.3 | 78.0 | 5.60E+05 | 1.20E−02 | 2.14E−08 | 1.0 |
| mAb10988 | 279.2 ± 2.3 | 63.6 | 8.29E+05 | 2.71E−02 | 3.27E−08 | 0.4 |
| mAb10989 | 316.7 ± 1.6 | 114.3 | 1.86E+06 | 2.78E−03 | 1.50E−09 | 4.2 |
| mAb10996 | 414.2 ± 2.8 | 37.5 | 1.41E+05 | 2.28E−02 | 1.61E−07 | 0.5 |
| mAb10998 | 212.3 ± 1 | 17.7 | 3.54E+05 | 1.84E−02 | 5.21E−08 | 0.6 |
| mAb11000 | 322.6 ± 3.5 | 73.6 | 1.09E+06 | 1.14E−03 | 1.04E−09 | 10.1 |
| mAb11002 | 291.7 ± 2.7 | 13.8 | 1.65E+05 | 6.73E−03 | 4.07E−08 | 1.7 |
| mAb11004 | 232.9 ± 0.6 | 76.4 | 3.79E+05 | 3.24E−03 | 8.54E−09 | 3.6 |
| mAb11006 | 277.2 ± 1.1 | 66.9 | 9.67E+04 | 4.40E−04 | 4.55E−09 | 26.3 |
| mAb11008 | 214.9 ± 1.5 | 40.8 | 9.30E+04 | 3.27E−03 | 3.52E−08 | 3.5 |
| mAb11010 | 221.8 ± 1.3 | 76.8 | 1.11E+06 | 2.74E−03 | 2.47E−09 | 4.2 |
| mAb1932 | 205 ± 0.8 | 5.3 | NB | NB | NB | NB |

TABLE 30

Binding kinetics parameters of SARS-COV-2 RBD-MMH binding to anti-SARS-COV-2-S monoclonal antibodies at 37° C.

| mAb Captured (mAb#) | mAb Capture Level (RU) | 90 nM Ag Bound (RU) | $k_a$ (1/Ms) | $k_d$ (1/s) | KD (M) | t½ (min) |
|---|---|---|---|---|---|---|
| mAb10913 | 366 ± 6 | 49 | 5.29E+05 | 5.56E−02 | 1.05E−07 | 0.2 |
| mAb10914 | 401 ± 3 | 63 | 2.51E+05 | 1.58E−02 | 6.27E−08 | 0.7 |
| mAb10915 | 401 ± 3 | 93 | 1.57E+05 | 7.57E−04 | 4.84E−09 | 15.3 |
| mAb10920 | 394 ± 3 | 73 | 6.10E+05 | 3.41E−02 | 5.60E−08 | 0.3 |
| mAb10921 | 394 ± 3 | 87 | 1.60E+05 | 2.07E−03 | 1.29E−08 | 5.6 |
| mAb10922 | 405.6 ± 1.7 | 130 | 1.04E+06 | 9.27E−03 | 8.89E−09 | 1.2 |
| mAb10923 | 355 ± 3 | 84 | 6.15E+05 | 2.76E−02 | 4.48E−08 | 0.4 |
| mAb10924 | 406 ± 5 | 110 | 2.99E+05 | 6.18E−03 | 2.07E−08 | 1.9 |
| mAb10930 | 373.9 ± 3.5 | 42 | 2.30E+05 | 1.87E−02 | 8.14E−08 | 0.6 |
| mAb10932 | 406 ± 4 | 119 | 1.43E+05 | 6.55E−04 | 4.57E−09 | 17.6 |
| mAb10933 | 368 ± 3 | 124 | 2.37E+06 | 8.28E−03 | 3.49E−09 | 1.4 |
| mAb10934 | 368 ± 3 | 117 | 4.62E+06 | 2.32E−02 | 5.02E−09 | 0.5 |
| mAb10935 | 430 ± 5 | 75 | 4.37E+05 | 3.74E−02 | 8.56E−08 | 0.3 |
| mAb10936 | 402 ± 3 | 126 | 9.75E+05 | 5.51E−03 | 5.65E−09 | 2.1 |
| mAb10937 | 402 ± 3 | 107 | 9.68E+05 | 2.43E−02 | 2.51E−08 | 0.5 |
| mAb10938 | 434 ± 3 | 100 | 1.06E+05 | 1.12E−03 | 1.05E−08 | 10.3 |
| mAb10939 | 439 ± 5 | 90 | 2.40E+05 | 9.46E−03 | 3.95E−08 | 1.2 |
| mAb10940 | 434 ± 3 | 124 | 1.42E+06 | 1.23E−02 | 8.70E−09 | 0.9 |
| mAb10941 | 418 ± 3 | 134 | 1.97E+05 | 1.75E−03 | 8.87E−09 | 6.6 |
| mAb10954 | 371.8 ± 2 | 131 | 5.68E+05 | 1.35E−03 | 2.38E−09 | 8.6 |
| mAb10955 | 384.1 ± 6.3 | 81 | 2.85E+05 | 1.26E−02 | 4.43E−08 | 0.9 |
| mAb10956 | 383 ± 2.3 | 89 | 3.56E+05 | 1.30E−02 | 3.65E−08 | 0.9 |
| mAb10957 | 322 ± 2.1 | 124 | 2.44E+05 | 6.19E−04 | 2.54E−09 | 18.7 |
| mAb10964 | 333.3 ± 4.6 | 121 | 3.68E+06 | 2.08E−03 | 5.64E−10 | 5.6 |
| mAb10965 | 326.8 ± 1.2 | 67 | 2.23E+05 | 9.19E−03 | 4.12E−08 | 1.3 |
| mAb10966 | 350.2 ± 2.9 | 118 | 4.40E+05 | 1.67E−03 | 3.79E−09 | 6.9 |
| mAb10967 | 336 ± 2.2 | 108 | 1.91E+05 | 2.62E−04 | 1.38E−09 | 44.1 |
| mAb10969 | 349.5 ± 3 | 86 | 4.07E+05 | 1.59E−02 | 3.92E−08 | 0.7 |
| mAb10970 | 393.8 ± 3.4 | 104 | 3.33E+05 | 7.58E−03 | 2.28E−08 | 1.5 |
| mAb10971 | 347 ± 1.9 | 116 | 3.92E+05 | 9.79E−04 | 2.50E−09 | 11.8 |
| mAb10977 | 341 ± 1.4 | 122 | 4.35E+05 | 1.31E−03 | 3.01E−09 | 8.8 |
| mAb10982 | 347.5 ± 1.3 | 67 | 1.94E+05 | 9.42E−03 | 4.85E−08 | 1.2 |
| mAb10984 | 422.5 ± 0.7 | 144 | 3.28E+05 | 1.82E−03 | 5.55E−09 | 6.3 |
| mAb10985 | 395.5 ± 2.5 | 134 | 2.57E+06 | 4.23E−03 | 1.65E−09 | 2.7 |
| mAb10986 | 349.3 ± 1.5 | 129 | 8.24E+05 | 5.83E−04 | 7.07E−10 | 19.8 |
| mAb10987 | 354 ± 5.3 | 82 | 8.38E+05 | 2.51E−02 | 3.00E−08 | 0.5 |
| mAb10988 | 364.4 ± 2.6 | 52 | 9.19E+05 | 5.78E−02 | 6.29E−08 | 0.2 |
| mAb10989 | 405.6 ± 1.9 | 128 | 2.97E+06 | 1.16E−02 | 3.90E−09 | 1.0 |
| mAb10996 | 524.3 ± 2.8 | 43 | 1.06E+05 | 1.25E−02 | 1.19E−07 | 0.9 |

TABLE 30-continued

Binding kinetics parameters of SARS-COV-2 RBD-MMH binding to anti-SARS-COV-2-S monoclonal antibodies at 37° C.

| mAb Captured (mAb#) | mAb Capture Level (RU) | 90 nM Ag Bound (RU) | $k_a$ (1/Ms) | $k_d$ (1/s) | KD (M) | t½ (min) |
|---|---|---|---|---|---|---|
| mAb10998 | 271.1 ± 0.6 | 15 | 2.81E+05 | 7.54E−03 | 2.68E−08 | 1.5 |
| mAb11000 | 418.2 ± 1 | 87 | 2.89E+05 | 9.10E−03 | 3.14E−08 | 1.3 |
| mAb11002 | 370.1 ± 2.5 | 12 | 2.81E+05 | 7.54E−03 | 2.68E−08 | 1.5 |
| mAb11004 | 297.8 ± 0.4 | 79 | 1.75E+06 | 1.48E−03 | 8.48E−10 | 7.8 |
| mAb11006 | 350.2 ± 1.2 | 92 | 6.28E+05 | 1.48E−02 | 2.35E−08 | 0.8 |
| mAb11008 | 289.4 ± 2.7 | 38 | 1.42E+05 | 1.51E−03 | 1.06E−08 | 7.6 |
| mAb11010 | 286.3 ± 0.5 | 96 | 1.67E+05 | 1.45E−02 | 8.71E−08 | 0.8 |
| mAb1932 | 265.3 ± 1.4 | 5 | NB | NB | NB | NB |

TABLE 31

Binding kinetics parameters of SARS-COV-2 RBD-mFc binding to anti-SARS-COV-2-S monoclonal antibodies at 25° C.

| mAb Captured (mAb#) | mAb Capture Level (RU) | 30 nM Ag Bound (RU) | $k_a$ (1/Ms) | $k_d$ (1/s) | KD (M) | t½ (min) |
|---|---|---|---|---|---|---|
| mAb10913 | 107 ± 0.4 | 65 | 5.00E+06 | 2.77E−04 | 5.53E−11 | 41.7 |
| mAb10914 | 116 ± 0.8 | 44 | 2.59E+05 | 1.40E−04 | 5.40E−10 | 82.5 |
| mAb10915 | 103 ± 0.2 | 41 | 2.83E+05 | 9.13E−06 | 3.23E−11 | 1265.1 |
| mAb10920 | 116 ± 0.9 | 69 | 5.08E+06 | 2.55E−04 | 5.02E−11 | 45.3 |
| mAb10921 | 104 ± 0.2 | 39 | 2.66E+05 | 3.34E−05 | 1.25E−10 | 345.8 |
| mAb10922 | 111.4 ± 0.8 | 80 | 3.20E+06 | 5.64E−05 | 1.76E−11 | 204.8 |
| mAb10923 | 110 ± 1.0 | 71 | 3.69E+06 | 1.35E−04 | 3.67E−11 | 85.6 |
| mAb10924 | 121 ± 0.5 | 74 | 8.09E+05 | 7.63E−05 | 9.43E−11 | 151.4 |
| mAb10930 | 104.2 ± 0.9 | 61 | 9.43E+05 | 1.71E−04 | 1.81E−10 | 67.5 |
| mAb10932 | 121 ± 0.8 | 60 | 2.95E+05 | 2.85E−05 | 9.67E−11 | 405.3 |
| mAb10933 | 108 ± 0.5 | 72 | 6.16E+06 | 6.10E−05 | 9.89E−12 | 189.3 |
| mAb10934 | 113 ± 0.5 | 70 | 1.12E+07 | 1.56E−04 | 1.39E−11 | 74.0 |
| mAb10935 | 128 ± 0.8 | 88 | 1.35E+06 | 1.07E−04 | 7.94E−11 | 107.9 |
| mAb10936 | 117 ± 0.4 | 74 | 1.78E+06 | 5.04E−05 | 2.83E−11 | 229.2 |
| mAb10937 | 106 ± 0.3 | 67 | 1.78E+06 | 5.40E−05 | 3.04E−11 | 213.9 |
| mAb10938 | 128 ± 1.5 | 47 | 2.42E+05 | 1.69E−05 | 7.02E−11 | 683.4 |
| mAb10939 | 127 ± 0.8 | 67 | 7.22E+05 | 8.74E−05 | 1.21E−10 | 132.2 |
| mAb10940 | 102 ± 0.4 | 67 | 3.72E+06 | 4.66E−05 | 1.25E−11 | 247.9 |
| mAb10941 | 125 ± 0.2 | 68 | 3.70E+05 | 3.48E−05 | 9.43E−11 | 331.9 |
| mAb10954 | 108.8 ± 1 | 86 | 2.35E+06 | 4.78E−05 | 2.03E−11 | 241.6 |
| mAb10955 | 109.8 ± 0.8 | 76 | 1.20E+06 | 9.22E−05 | 7.71E−11 | 125.3 |
| mAb10956 | 104.1 ± 0.5 | 74 | 1.46E+06 | 1.30E−04 | 8.87E−11 | 88.8 |
| mAb10957 | 104.7 ± 0.5 | 77 | 1.02E+06 | 3.35E−05 | 3.27E−11 | 344.8 |
| mAb10964 | 93.3 ± 0.3 | 70 | 9.30E+06 | 3.69E−05 | 3.97E−12 | 313.0 |
| mAb10965 | 94.2 ± 0.8 | 63 | 6.94E+05 | 1.56E−04 | 2.25E−10 | 74.0 |
| mAb10966 | 100.2 ± 0.4 | 73 | 1.50E+06 | 3.37E−05 | 2.24E−11 | 342.7 |
| mAb10967 | 93.3 ± 0.2 | 60 | 6.64E+05 | 1.35E−05 | 2.03E−11 | 855.6 |
| mAb10969 | 111.4 ± 0.8 | 80 | 4.64E+05 | 1.00E−04 | 2.16E−10 | 115.5 |
| mAb10970 | 113.4 ± 0.7 | 85 | 2.19E+06 | 4.05E−04 | 1.85E−10 | 28.5 |
| mAb10971 | 99 ± 0.5 | 72 | 1.40E+06 | 4.09E−05 | 2.92E−11 | 282.4 |
| mAb10977 | 109.1 ± 0.4 | 73 | 1.82E+06 | 2.29E−05 | 1.26E−11 | 504.4 |
| mAb10982 | 94.8 ± 0.1 | 59 | 9.10E+05 | 8.06E−05 | 8.86E−11 | 143.3 |
| mAb10984 | 121 ± 0.6 | 89 | 1.39E+06 | 3.97E−05 | 2.86E−11 | 290.9 |
| mAb10985 | 112.7 ± 0.3 | 77 | 8.09E+06 | 8.51E−05 | 1.05E−11 | 135.7 |
| mAb10986 | 94.2 ± 0.5 | 66 | 2.70E+06 | 2.40E−05 | 8.88E−12 | 481.3 |
| mAb10987 | 98 ± 0.7 | 73 | 3.19E+06 | 4.24E−04 | 1.33E−10 | 27.2 |
| mAb10988 | 101.6 ± 0.6 | 69 | 4.96E+06 | 5.08E−04 | 1.02E−10 | 22.7 |

TABLE 31-continued

Binding kinetics parameters of SARS-COV-2 RBD-mFc binding to anti-SARS-COV-2-S monoclonal antibodies at 25° C.

| mAb Captured (mAb#) | mAb Capture Level (RU) | 30 nM Ag Bound (RU) | $k_a$ (1/Ms) | $k_d$ (1/s) | KD (M) | t½ (min) |
|---|---|---|---|---|---|---|
| mAb10989 | 112.1 ± 0.4 | 77 | 1.08E+07 | 9.63E−05 | 8.95E−12 | 119.9 |
| mAb10996 | 104.2 ± 0.9 | 61 | 5.62E+05 | 8.02E−04 | 1.43E−09 | 14.4 |
| mAb10998 | 94.8 ± 0.1 | 59 | 1.47E+06 | 3.58E−03 | 2.44E−09 | 3.2 |
| mAb11000 | 112.7 ± 0.3 | 77 | 1.11E+06 | 1.27E−04 | 1.15E−10 | 90.9 |
| mAb11002 | 121 ± 0.6 | 89 | 5.54E+05 | 2.47E−03 | 4.46E−09 | 4.7 |
| mAb11004 | 94.2 ± 0.5 | 66 | 6.95E+05 | 6.40E−05 | 9.21E−11 | 180.5 |
| mAb11006 | 98 ± 0.7 | 73 | 3.30E+05 | 5.21E−05 | 1.58E−10 | 221.7 |
| mAb11008 | 101.6 ± 0.6 | 69 | 3.90E+05 | 1.92E−04 | 4.92E−10 | 60.2 |
| mAb11010 | 112.1 ± 0.4 | 77 | 1.14E+06 | 8.99E−05 | 7.89E−11 | 128.5 |
| mAb1932 | 97.8 ± 0.2 | 3 | NB | NB | NB | NB |

TABLE 32

Binding kinetics parameters of SARS-COV-2 RBD-mFc binding to anti-SARS-COV-2-S monoclonal antibodies at 37° C.

| mAb Captured (mAb#) | mAb Capture Level (RU) | 30 nM Ag Bound (RU) | $k_a$ (1/Ms) | $k_d$ (1/s) | KD (M) | t½ (min) |
|---|---|---|---|---|---|---|
| mAb10913 | 147 ± 0.8 | 75 | 6.32E+06 | 1.73E−03 | 2.74E−10 | 6.7 |
| mAb10914 | 163 ± 1.2 | 70 | 6.91E+05 | 2.20E−04 | 3.18E−10 | 52.5 |
| mAb10915 | 141 ± 0.6 | 63 | 4.41E+05 | 6.89E−05 | 1.56E−10 | 167.6 |
| mAb10920 | 155 ± 1.1 | 83 | 6.31E+06 | 7.53E−04 | 1.19E−10 | 15.3 |
| mAb10921 | 135 ± 0.3 | 62 | 4.58E+05 | 1.25E−04 | 2.73E−10 | 92.4 |
| mAb10922 | 149.1 ± 1 | 97 | 4.60E+06 | 1.60E−04 | 3.49E−11 | 72.2 |
| mAb10923 | 144 ± 0.8 | 88 | 5.53E+06 | 1.85E−04 | 3.36E−11 | 62.4 |
| mAb10924 | 160 ± 1.1 | 98 | 1.17E+06 | 1.31E−04 | 1.12E−10 | 88.2 |
| mAb10930 | 142.9 ± 0.4 | 72 | 1.49E+06 | 5.97E−04 | 3.99E−10 | 19.3 |
| mAb10932 | 164 ± 1.5 | 89 | 4.48E+05 | 6.86E−05 | 1.53E−10 | 168.4 |
| mAb10933 | 152 ± 0.9 | 89 | 7.30E+06 | 7.94E−05 | 1.09E−11 | 145.5 |
| mAb10934 | 151 ± 0.7 | 87 | 1.36E+07 | 2.93E−04 | 2.16E−11 | 39.4 |
| mAb10935 | 171 ± 0.8 | 101 | 5.68E+06 | 4.94E−04 | 8.69E−11 | 23.4 |
| mAb10936 | 161 ± 1.0 | 94 | 3.81E+06 | 6.75E−05 | 1.77E−11 | 171.1 |
| mAb10937 | 141 ± 0.6 | 85 | 4.47E+06 | 5.74E−05 | 1.29E−11 | 201.2 |
| mAb10938 | 172 ± 1.2 | 76 | 3.78E+05 | 6.56E−05 | 1.73E−10 | 176.1 |
| mAb10939 | 169 ± 0.6 | 92 | 1.06E+06 | 1.65E−04 | 1.55E−10 | 70.0 |
| mAb10940 | 136 ± 0.6 | 85 | 5.54E+06 | 5.04E−05 | 9.10E−12 | 229.2 |
| mAb10941 | 164 ± 0.8 | 100 | 8.02E+05 | 8.01E−05 | 1.00E−10 | 144.2 |
| mAb10954 | 142.4 ± 0.8 | 105 | 3.02E+06 | 1.12E−04 | 3.69E−11 | 103.1 |
| mAb10955 | 146.8 ± 0.7 | 91 | 1.92E+06 | 3.88E−04 | 2.02E−10 | 29.8 |
| mAb10956 | 136.6 ± 0.4 | 91 | 2.17E+06 | 3.42E−04 | 1.58E−10 | 33.8 |
| mAb10957 | 137.7 ± 1.2 | 100 | 1.55E+06 | 7.19E−05 | 4.63E−11 | 160.6 |
| mAb10964 | 122.5 ± 0.3 | 84 | 1.05E+07 | 1.26E−04 | 1.20E−11 | 91.7 |
| mAb10965 | 125.7 ± 1 | 81 | 1.42E+06 | 3.38E−04 | 2.37E−10 | 34.2 |
| mAb10966 | 137.3 ± 1.1 | 92 | 2.45E+06 | 9.93E−05 | 4.05E−11 | 116.3 |
| mAb10967 | 123.3 ± 0.9 | 81 | 1.45E+06 | 3.33E−05 | 2.29E−11 | 346.8 |
| mAb10969 | 149.1 ± 1 | 97 | 8.11E+05 | 1.41E−04 | 1.74E−10 | 81.9 |
| mAb10970 | 149.9 ± 0.6 | 102 | 2.18E+06 | 4.20E−04 | 1.92E−10 | 27.5 |
| mAb10971 | 136.1 ± 0.8 | 90 | 2.37E+06 | 9.41E−05 | 3.97E−11 | 122.7 |

TABLE 32-continued

Binding kinetics parameters of SARS-COV-2 RBD-mFc binding to anti-SARS-COV-2-S monoclonal antibodies at 37° C.

| mAb Captured (mAb#) | mAb Capture Level (RU) | 30 nM Ag Bound (RU) | $k_a$ (1/Ms) | $k_d$ (1/s) | KD (M) | t½ (min) |
|---|---|---|---|---|---|---|
| mAb10977 | 145.8 ± 0.7 | 93 | 2.50E+06 | 1.07E−04 | 4.28E−11 | 107.9 |
| mAb10982 | 125.5 ± 0.8 | 74 | 1.23E+06 | 2.58E−04 | 2.10E−10 | 44.8 |
| mAb10984 | 158.4 ± 0.7 | 110 | 2.07E+06 | 8.36E−05 | 4.04E−11 | 138.2 |
| mAb10985 | 151.8 ± 0.7 | 87 | 9.36E+06 | 3.75E−04 | 4.01E−11 | 30.8 |
| mAb10986 | 125 ± 0.7 | 83 | 4.59E+06 | 5.79E−05 | 1.26E−11 | 199.5 |
| mAb10987 | 131.5 ± 0.7 | 87 | 5.04E+06 | 3.90E−04 | 7.75E−11 | 29.6 |
| mAb10988 | 138.6 ± 0.5 | 82 | 8.34E+06 | 7.90E−04 | 9.47E−11 | 14.6 |
| mAb10989 | 146.1 ± 0.6 | 92 | 1.38E+07 | 3.65E−04 | 2.65E−11 | 31.6 |
| mAb10996 | 142.9 ± 0.4 | 72 | 9.35E+05 | 2.47E−03 | 2.64E−09 | 4.7 |
| mAb10998 | 125.5 ± 0.8 | 74 | 8.79E+05 | 1.97E−02 | 2.24E−08 | 0.6 |
| mAb11000 | 151.8 ± 0.7 | 87 | 1.63E+06 | 2.71E−04 | 1.66E−10 | 42.6 |
| mAb11002 | 158.4 ± 0.7 | 110 | 5.06E+05 | 1.65E−02 | 3.26E−08 | 0.7 |
| mAb11004 | 125 ± 0.7 | 83 | 1.01E+06 | 1.18E−04 | 1.17E−10 | 97.9 |
| mAb11006 | 131.5 ± 0.7 | 87 | 3.88E+05 | 7.65E−05 | 1.97E−10 | 151.0 |
| mAb11008 | 138.6 ± 0.5 | 82 | 4.64E+05 | 4.05E−04 | 8.72E−10 | 28.5 |
| mAb11010 | 146.1 ± 0.6 | 92 | 1.59E+06 | 8.02E−05 | 5.05E−11 | 144.0 |
| mAb1932 | 128 ± 0.3 | 5 | NB | NB | NB | NB |

TABLE 33

Binding kinetics parameters of SARS-COV-2 Spike ECD foldon binding to anti-SARS-COV-2-S monoclonal antibodies at 25° C.

| mAb Captured (mAb#) | mAb Capture Level (RU) | 30 nM Ag Bound (RU) | $k_a$ (1/Ms) | $k_d$ (1/s) | KD (M) | t½ (min) |
|---|---|---|---|---|---|---|
| mAb10933 | 54.9 ± 0.5 | 34.3 | 1.32E+06 | 6.05E−05 | 4.58E−11 | 190.9 |
| mAb10934 | 48.8 ± 0.6 | 34.6 | 2.21E+06 | 1.36E−04 | 6.14E−11 | 84.9 |
| mAb10987 | 56.3 ± 0.4 | 23.7 | 8.92E+05 | 4.16E−05 | 4.67E−11 | 277.6 |
| mAb10989 | 58.6 ± 0.6 | 39.7 | 1.75E+06 | 9.19E−05 | 5.24E−11 | 125.7 |
| mAb1932 | 41.7 ± 0.3 | 0.7 | NB | NB | NB | NB |

TABLE 34

Binding kinetics parameters of SARS-COV-2 Spike ECD foldon to anti-SARS-COV-2-S monoclonal antibodies at 37° C.

| mAb Captured (mAb#) | mAb Capture Level (RU) | 30 nM Ag Bound (RU) | $k_a$ (1/Ms) | $k_d$ (1/s) | KD (M) | t½ (min) |
|---|---|---|---|---|---|---|
| mAb10933 | 83.7 ± 0.8 | 52.8 | 1.90E+06 | 7.90E−05 | 4.17E−11 | 146.2 |
| mAb10934 | 79.7 ± 0.7 | 40.1 | 2.85E+06 | 1.06E−04 | 3.71E−11 | 109.0 |
| mAb10987 | 82.5 ± 0.5 | 46.1 | 1.34E+06 | 5.74E−05 | 4.28E−11 | 201.2 |
| mAb10989 | 88.0 ± 0.9 | 57.5 | 2.38E+06 | 9.82E−05 | 4.12E−11 | 117.6 |
| mAb1932 | 64.4 ± 1.5 | 0.6 | NB | NB | NB | NB |

Example 15: Characterization of Anti-SARS-CoV-2-S mAbs in an Antibody-Dependent Cellular Cytotoxicity (ADCC) Assay The ability of antibodies targeting the spike protein of SARS-CoV-2 to interact with FcγR3a, an Fc-receptor prominently expressed on natural killer (NK) cells, and induce antibody dependent cellular cytotoxicity (ADCC), was measured using NK cells purified from 3 donors and target cells bound to antibodies. In this assay, effector cells were NK cells isolated from LeukoPaks isolated from 3 different donors. Target cells were engineered Jurkat T cells expressing human CD20 (used as a positive control with a CD20-targeting human IgG1 antibody) alone or in combination with the full-length SARS-CoV-2 spike protein. NK cells were incubated with target cells and engagement of FcγR3a via the Fc domain of human IgG1 antibodies bound to target cells led to the activation of the NK cells and target cell death. Cell killing was measured by assessing dead cell protease activity which drives increased luminescence and was used as the assay readout.

Jurkat T cells were engineered to constitutively express full length human CD20 (amino acids M1-P297 of NCBI accession number NP_690605.1). Jurkat/hCD20 cells were stained for CD20 expression and maintained in RPMI+10% FBS+P/S/G+250 μg/ml hygromycin growth medium. These cells, without further modification, were used as a negative control, and will be referred to as Jurkat/hCD20 cells.

The above cells were then were engineered to constitutively express full-length SARS-CoV-2 spike Protein (amino acids M1-T1273 of NCBI accession number YP_009724390.1). These cells were then sorted for high expression of the spike protein and maintained in RPMI+10% FBS+P/S/G+1 μg/ml puromycin+250 μg/ml hygromycin growth medium, and will be referred to as Jurkat/hCD20/SARS-CoV-2 spike cells.

NK cells were isolated from donor LeukoPaks using Stem Cell Technologies RosetteSep Human NK cell Enrichment kits following the manufacturer's protocol.

One day before the assay, the Jurkat/hCD20 and Jurkat/hCD20/SARS-CoV-2 spike cells were split to $5\times10^5$ cells/ml in their respective growth media. On the day of the assay, unstimulated human NK cells were isolated from leukocyte-enriched whole blood by density gradient centrifugation using NK RosetteSep Human NK Cell Enrichment Cocktail (Stem Cell Technologies) and SepMate tubes (Stem Cell Technologies) according to the manufacturer's instructions. NK cell enrichment was confirmed with a blood cell phenotyping cocktail of fluorophore-conjugated antibodies (anti-CD56, anti-CD3, anti-CD19, and anti-CD14).

Jurkat/hCD20 or Jurkat/hCD20/SARS-CoV-2 spike cells were resuspended in assay media (RPMI supplemented with 1% BSA, 100 U/ml penicillin, 100 μg/ml streptomycin, and 292 μg/ml L-glutamine) and added in triplicate to opaque, white 96-well flat-bottom plates at a concentration of $5\times10^3$ cells/well. Four anti-SARS-CoV-2 spike antibodies and a negative isotype-matched control antibody were titrated in a 1:4 serial dilution ranging from 191 fM to 200 nM final concentration in assay media. A no-antibody control was included in each titration (providing a background signal, e.g., for nonspecific lysis of target cells in the presence of NK cells). A positive control antibody for ADCC (anti-CD20) was titrated in a 1:4 serial dilution ranging from 9.5 fM to 10 nM final concentration. Human NK cells were diluted in assay media and added to the assay plate at a final concentration of $2.5\times10^4$ cells/well. To assess spontaneous lysis, untreated Jurkat cells alone (target cells) and NK cells alone (effector cells) were incubated in separate wells. Plates were incubated at 37° C., 5% $CO_2$ for 3.5 hours. After incubation, the plates were equilibrated to room temperature for 10 minutes, followed by the addition of CytoTox Glo reagent (Promega) to the wells for 15 minutes with shaking. The luminescence signal was measured as a readout of cytotoxicity using an ENVISION plate reader. The cytotoxic response was calculated as follows:

$$\text{Cytotoxicity (\%)}=(\text{Experimental Signal}-SBS_{(target\ cells)}-SBS_{(effector\ cells)})/(\text{Max signal}_{(target\ cells\ w/digitonin)}-SBS_{(target\ cells)})\times100,$$

where SBS represents the spontaneous background signal. From this value, background was subtracted: (Value)−(Average of no-antibody control).

For $EC_{50}$ determinations, % Cytotoxicity was analyzed with GraphPad Prism using a 4-parameter logistic equation over a 12-point dose response curve, including the no antibody control. The experiment was run in triplicate with 3 donors.

The $EC_{50}$ values and maximum (Max) % Cytotoxicity ranges from the various donors are summarized in Table 35.

With Jurkat/hCD20/SARS-CoV-2 spike target cells, all four SARS-CoV-2 spike antibodies showed greater max percent cytotoxicity compared to IgG1 control antibody. The $EC_{50}$ values of the SARS-CoV-2 spike antibodies ranged from 20.0 pM to 25.1 nM, and the Max (% Cytotoxicity) values ranged from 6.1% to 19.8%. The positive CD20 control antibody showed a range of Max (% Cytotoxicity) from 27.5 to 44.6% with $EC_{50}$ values ranging from 16.9 pM to 38.6 pM across three donor NK cells.

With Jurkat/hCD20 (negative control) target cells, all four SARS-CoV-2 spike antibodies behaved similar to the negative control antibody, showing minimal activity. Whereas the positive CD20 control antibody showed a range of Max (% Cytotoxicity from 24.5 to 26.4% with $EC_{50}$ values ranging from 16.3 pM to 32.9 pM across three donor NK cells.

TABLE 35

| ADCC Activity | | | | |
|---|---|---|---|---|
| | NK Donor 1-3 | | | |
| | Jurkat/hCD20 | | Jurkat/hCD20/SARS-CoV2 Spike protein | |
| | EC50 (M) Range | Max (% Cytotoxicity) Range | EC50 (M) Range | Max (% Cytotoxicity) Range |
| mAb10933 | ND | 1.1 to 4.9 | 1.24E−10 to 2.00E−11[b] | 11.4 to 17.5 |
| mAb10987 | ND | 1.9 to 3.1 | 1.12E−10 to 3.32E−10 | 17.1 to 19.8 |
| mAb10989 | ND | 1.9 to 2.6 | 1.56E−10[a] | 8.4 to 10.6 |
| mAb10934 | ND | 0 to 4.6 | 2.51E−08 to 2.17E−11 | 6.1 to 11.6 |
| IgG1 Control | ND | 0 to 4.2 | ND[b] | 1.8 to 7.2 |
| Anti-CD20 IgG1 | 1.63E−11 to 3.29E−11 | 24.5 to 26.4 | 1.69E−11 to 3.86E−11 | 27.5 to 44.6 |

$EC_{50}$ and Max (% Cytotoxicity) are a range of values from 3 donors.
Max (% Cytotoxicity) is the highest mean % Cytotoxicity within the tested dose range.
[a]For two donors, dose dependent response observed but EC50 could not be calculated (NC).
[b]For one donor, dose dependent response observed but EC50 could not be calculated (NC).
ND = Not determined. Dose dependent response was not observed.

Example 16: Characterization of Anti-SARS-CoV-2-S mAbs in an Antibody-Dependent Cellular Phagocytosis (ADCP) Assay The ability of antibodies targeting the spike protein of SARS-CoV-2 to induce phagocytosis of Jurkat cells engineered to express the SARS-CoV-2 full length spike protein was evaluated. Macrophages differentiated from monocytes in the presence of macrophage colony-stimulating factor (M-CSF) were used as effector cells in an antibody dependent cellular phagocytosis (ADCP) assay. An IgG1 isotype as a negative control was evaluated in parallel. Phagocytosis was assessed by measuring the number of fluorescently labeled target cells colocalizing with fluorescently labeled macrophages using an Opera Phenix High-Content Screening System.

To generate Jurkat/hCD20 target cells, Jurkat T cells were engineered to constitutively express full length human CD20 (amino acids M1-P297 of accession number NP_690605.1). Jurkat/hCD20 cells were stained for CD20 expression and maintained in RPMI+10% FBS+P/S/G+250 μg/ml hygromycin growth medium. These cells were used as a negative control.

To generate Jurkat/hCD20/SARS-CoV-2 spike target cells, Jurkat/hCD20 T cells were engineered to constitutively express full-length SARS-CoV-2 spike protein (amino acids M1-T1273 of accession number YP_009724390.1). Jurkat/hCD20/SARS-CoV-2 spike cells were sorted for high expression of the spike protein and maintained in RPMI+10% FBS+P/S/G+1 μg/ml puromycin+250 μg/ml hygromycin growth medium.

To generate effector cells, macrophages were differentiated from monocytes in the presence of M-CSF. Frozen CD14+ monocytes (Lonza) were thawed, resuspended in assay media (RPMI 1640 supplemented with 10% FBS, 100 U/ml penicillin, 100 μg/ml streptomycin, and 292 μg/ml L-glutamine, NaPyr, HEPES, NEAA, and 10 μM BME), supplemented with 100 ng/ml M-CSF, and plated at $5.5\times10^4$ cells/well into clear-bottom, collagen-coated 96-well plates for differentiation into macrophages over 7 days. Fresh M-CSF (100 ng/ml) was added on day 4.

One day before the assay, Jurkat target cells were split to $5\times10^5$ cells/ml in their respective growth media. On the day of the experiment, target cells and monocyte-derived macrophages were incubated in PBS supplemented with either CellTrace CFSE dye or CellTrace Violet dye, respectively, for 15 minutes at 37° C., 5% $CO_2$. CFSE-labeled target cells were washed and resuspended in assay media (RPMI 1640 supplemented with 10% FBS, 100 U/ml penicillin, 100 μg/ml streptomycin, and 292 μg/ml L-glutamine, NaPyr, HEPES, NEAA, and 10 BME) and added in duplicate to 96-well U-bottom plates at a density of $6\times10^4$ cells/well. 4 anti-SARS-CoV-2 spike and the IgG1 control antibodies were titrated in assay media in a 1:5 serial dilution ranging from 51 fM to 20 nM final concentration and added to the plates. The zero-antibody point was represented by 10 fM in GraphPad Prism.

After 15 minutes of incubation on ice the mixture of target cells, with or without titrated antibody, was then transferred to plates containing the violet-labelled macrophages and plates were incubated at 37° C., 5% CO2 for 30 minutes. Wells were washed with PBS three times, followed by addition of 4.21% formaldehyde in PBS supplemented with 2.5 uM DRAQ5.

After a 20 minute incubation, wells were washed with PBS and imaged in both the 488 nm (CFSE-labelled target cells) and 375 nm (violet-labelled macrophages) excitation channels using an Opera Phenix High-Content Screening System. Image analysis was performed in Harmony software. Image segmentation in the 375 nm excitation channel was used to identify the macrophage population. Image segmentation in the 488 nm excitation channel was used to identify the target cells. Phagocytosis was quantified by identifying the macrophage population which contained target cells within them.

Percent phagocytosis was calculated by comparing number of macrophages undergoing phagocytosis to total macrophage cell number. From this value, background was subtracted to derive % ADCP: (Value)−(Average of No antibody=background phagocytosis). For $EC_{50}$ determinations, % ADCP was analyzed with GraphPad Prism using a 4-parameter logistic equation over a 10-point dose response curve, including the no antibody control. Maximum (Max) % ADCP was determined as the highest mean % ADCP value measured within a tested dose range. The assay was performed in duplicate across two donors, and results for one representative donor are shown.

The $EC_{50}$ values and maximum (Max) % ADCP are summarized in Table 36. When tested in Jurkat/hCD20/SARS-CoV-2 spike cells, all four anti-SARS-CoV-2 spike antibodies showed greater Max % ADCP compared to an IgG1 control antibody. The $EC_{50}$ values of the anti-SARS-CoV-2 spike antibodies ranged from 2.72 pM to 6.33 pM, and Max % ADCP ranged from 40.1% to 56.7%. When tested in Jurkat/hCD20 (negative control) target cells, all four anti-SARS-CoV-2 spike antibodies behaved similarly to the negative control antibody and had minimal activity.

TABLE 36

ADCP activity

| mAb# | Jurkat/hCD20 cells $EC_{50}$ [M] | Jurkat/hCD20 cells Max (% ADCP) | Jurkat/hCD20/SARS-CoV-2 Spike cells $EC_{50}$ [M] | Jurkat/hCD20/SARS-CoV-2 Spike cells Max (% ADCP) |
|---|---|---|---|---|
| mAb10933 | ND | 3.67 | 5.79E−12 | 53.4 |
| mAb10987 | ND | 5.60 | 6.33E−12 | 56.7 |
| mAb10989 | ND | 3.52 | 4.86E−12 | 56.0 |
| mAb10934 | ND | 2.05 | 2.72E−12 | 40.1 |
| IgG1 Isotype Control | ND | 1.97 | ND | 10.4 |

ND: Not determined because a concentration-dependent response was not observed
Max (% ADCP) is the highest mean % ADCP value within tested dose range.

Example 17: Anti-SARS-CoV-2 Antibodies Block RBD Binding to hACE2 as Determined by ELISA An ELISA-based blocking assay was used to determine the ability of anti-SARS-CoV-2 antibodies to block the binding of the SARS-CoV-2 Spike protein receptor binding domain (RBD) to its receptor, human angiotensin converting enzyme 2 (hACE2).

The SARS-CoV-2 protein used in this assay was comprised of the receptor binding domain (RBD) portion of the SARS-CoV-2 Spike protein (amino acids Arg319-Phe541) expressed with the Fc portion of the human IgG1 at the c-terminus (SARS-CoV-2 RBD-hFc) The human ACE2 protein used in the experiments was purchased from R&D Systems and was comprised of amino acids Gln18-Ser740 with a C-terminal 10×-Histidine tag (hACE2-His; NCBI Accession No. Q9BYF1).

Experiments were carried out using the following procedure. A monoclonal anti-Penta-His antibody (Qiagen) was coated at 1 μg/ml in PBS on a 96-well microtiter plate overnight at 4° C. The hACE2-His receptor was added at 0.2 ug/ml in PBS and bound for two hours at room temperature (RT). Nonspecific binding sites were subsequently blocked using a (w/v) solution of BSA in PBS. In other microtiter plates, a constant amount of 100 pM of SARS-CoV-2 RBD-hFc protein was bound with anti-SARS-CoV-2 antibodies and an isotype IgG1 antibody control at dilutions from 0.0008 nM to 50 nM in PBS+0.5% BSA. After a one-hour incubation, the mixture solutions were transferred to the microtiter plate coated hACE2-His. After 1.5 hours of incubation at RT, the wells were washed, and plate-bound SARS-CoV2 was detected with goat-anti-human IgG antibody conjugated with horseradish peroxidase (HRP) (Jackson). The plates were then developed using TMB substrate solution (BD Biosciences, #555214) according to manufacturer's recommendation and absorbance at 450 nm was measured on a Victor X5 plate reader.

Binding data were analyzed using a sigmoidal dose-response model within Prism™ software (GraphPad). The calculated IC50 value, defined as the concentration of antibody required to block 50% of SARS-CoV-2 RBD-hFc binding to plate-coated hACE2-His, was used as an indicator of blocking potency. Percent blocking was defined based on the background-corrected binding signal observed at the highest antibody concentration tested using this formula and reported for all tested antibodies:

$$\%\ \text{Blocking} = 100 - \left(\frac{[\text{Experimental Signal}_{(highest\ Ab\ conc)} - \text{Background Signal}_{(buffer)}]}{[\text{Maximum Signal}_{(hEGF\text{-}mFc\ alone)} - \text{Background Signal}_{(buffer)}]} \times 100\right)$$

Antibodies that blocked binding less than or equal to 50% at the highest concentration tested were classified as non-blockers and IC50 values were not reported for those antibodies.

The ability of anti-SARS-CoV-2 antibodies to block SARS-CoV-2 RBD binding to human ACE2 was assessed using a blocking ELISA. In this assay 100 pM SARS-CoV-2 RBD-hFc was titrated with a wide range of the concentrations of the anti-SARS-CoV-2-S antibody and the inhibition of the presence of the antibody on RBD binding to hACE2-His was evaluated. The plate-bound RBD-hFc was detected with an HRP conjugated anti-hFc antibody.

The blocking IC50s and maximum blocking at the highest tested concentrations of the anti-SARS-CoV-2-S antibodies are summarized in Table 37, and the blocking curves shown in FIGS. 2-9. Of the 46 antibodies tested, 44 displayed antibody concentration-dependent blocking of RBD.hFc binding to hACE-2. IC50 values ranged from 41 pM to 4.5 nM and maximum blocking ranging from 55% to about 100% at the highest antibody concentration tested. Two antibodies out of 46 tested showed no blocking activities under the assay conditions. The irrelevant isotype control antibody showed no blocking activity, as expected.

TABLE 37

Blocking potency of Anti-SAR-COV-2 Antibodies on Spike RBD-hFc Binding to Immobilized Human ACE-2

| mAb | Assay Run # | Blocking 100 pM (RBD) · hFc to ACE2 $IC_{50}$, M | Blocking 100 pM (RBD) · hFc to ACE2 % Blocking |
|---|---|---|---|
| mAb10913 | 1 | 2.17E−10 | 80 |
| mAb10914 | 1 | 9.80E−10 | 93 |
| mAb10915 | 1 | 3.21E−10 | 99 |
| mAb10920 | 1 | 3.38E−10 | 95 |
| mAb10920 | 3 | 1.39E−10 | 87 |
| mAb10921 | 1 | 4.33E−10 | 99 |
| mAb10921 | 3 | 5.07E−10 | 94 |
| mAb10922 | 2 | 6.65E−11 | 97 |
| mAb10923 | 1 | 1.49E−10 | 94 |
| mAb10923 | 3 | 1.84E−10 | 85 |
| mAb10924 | 1 | 1.63E−10 | 98 |
| mAb10924 | 2 | 1.27E−10 | 98 |
| mAb10930 | 2 | 2.82E−10 | 86 |
| mAb10932 | 1 | 3.73E−10 | 99 |

TABLE 37-continued

Blocking potency of Anti-SAR-COV-2 Antibodies on Spike RBD-hFc Binding to Immobilized Human ACE-2

| mAb | Assay Run # | Blocking 100 pM (RBD) · hFc to ACE2 $IC_{50}$, M | Blocking 100 pM (RBD) · hFc to ACE2 % Blocking |
|---|---|---|---|
| mAb10933 | 1 | 7.07E−11 | 99 |
| mAb10933 | 3 | 6.53E−11 | 95 |
| mAb10933 | 2 | 5.22E−11 | 101 |
| mAb10934 | 1 | 6.60E−11 | 96 |
| mAb10934 | 3 | 5.97E−11 | 98 |
| mAb10934 | 2 | 4.80E−11 | 96 |
| mAb10935 | 1 | 1.02E−10 | 99 |
| mAb10935 | 2 | 6.94E−11 | 98 |
| mAb10936 | 1 | 8.75E−11 | 95 |
| mAb10936 | 2 | 7.10E−11 | 97 |
| mAb10937 | 1 | 6.49E−11 | 99 |
| mAb10938 | 1 | 2.75E−10 | 99 |
| mAb10939 | 1 | 1.75E−10 | 97 |
| mAb10939 | 3 | 2.63E−10 | 93 |
| mAb10940 | 1 | 6.52E−11 | 92 |
| mAb10941 | 1 | 2.27E−10 | 100 |
| mAb10941 | 2 | 2.06E−10 | 100 |
| mAb10954 | 2 | 7.11E−11 | 95 |
| mAb10955 | 2 | 1.41E−10 | 97 |
| mAb10956 | 2 | 1.85E−10 | 99 |
| mAb10957 | 2 | 1.69E−10 | 99 |
| mAb10964 | 3 | 6.83E−11 | 93 |
| mAb10964 | 2 | 6.25E−11 | 95 |
| mAb10965 | 2 | 2.13E−10 | 97 |
| mAb10966 | 2 | 1.60E−10 | 99 |
| mAb10967 | 2 | 2.80E−10 | 98 |
| mAb10969 | 3 | 2.15E−10 | 95 |
| mAb10970 | 2 | 1.07E−10 | 97 |
| mAb10971 | 2 | 1.49E−10 | 98 |
| mAb10977 | 3 | 8.71E−11 | 77 |
| mAb10977 | 2 | 7.11E−11 | 65 |
| mAb10982 | 2 | 1.16E−10 | 93 |
| mAb10984 | 2 | 7.75E−11 | 90 |
| mAb10985 | 3 | 6.96E−11 | 97 |
| mAb10985 | 2 | 4.11E−11 | 99 |
| mAb10986 | 2 | 7.54E−11 | 98 |
| mAb10987 | 3 | 2.85E−10 | 93 |
| mAb10987 | 2 | 1.81E−10 | 95 |
| mAb10988 | 2 | 8.64E−11 | 95 |
| mAb10989 | 3 | 5.91E−11 | 96 |
| mAb10989 | 2 | 4.28E−11 | 98 |
| mAb10996 | 3 | 6.10E−09 | 71 |
| mAb10998 | 3 | 4.30E−09 | 55 |
| mAb11000 | 3 | 4.50E−09 | 75 |
| mAb11002 | 3 | NBD | 7 |
| mAb11004 | 3 | NBD | 9 |
| mAb11006 | 3 | 2.20E−10 | 85 |
| mAb11008 | 3 | 1.49E−09 | 93 |
| mAb11010 | 3 | 1.47E−10 | 83 |
| mAb193250 IgG1 Control | 1 | — | −8 |
| mAb193250 IgG1 Control | 3 | — | −19 |
| mAb193250 IgG1 Control | 2 | — | −15 |

Note:
RBD-hFc at 100 pM was titrated with anti-SARS-COV-2-S antibodies in serial dilutions from 50 nM and bound RBD-hFc on immobilized hACE2 with a 10x histidine tag, and detected with HRP-conjugated anti-hFc antibody.
NBD; no blocking detected.

Figure 12B:
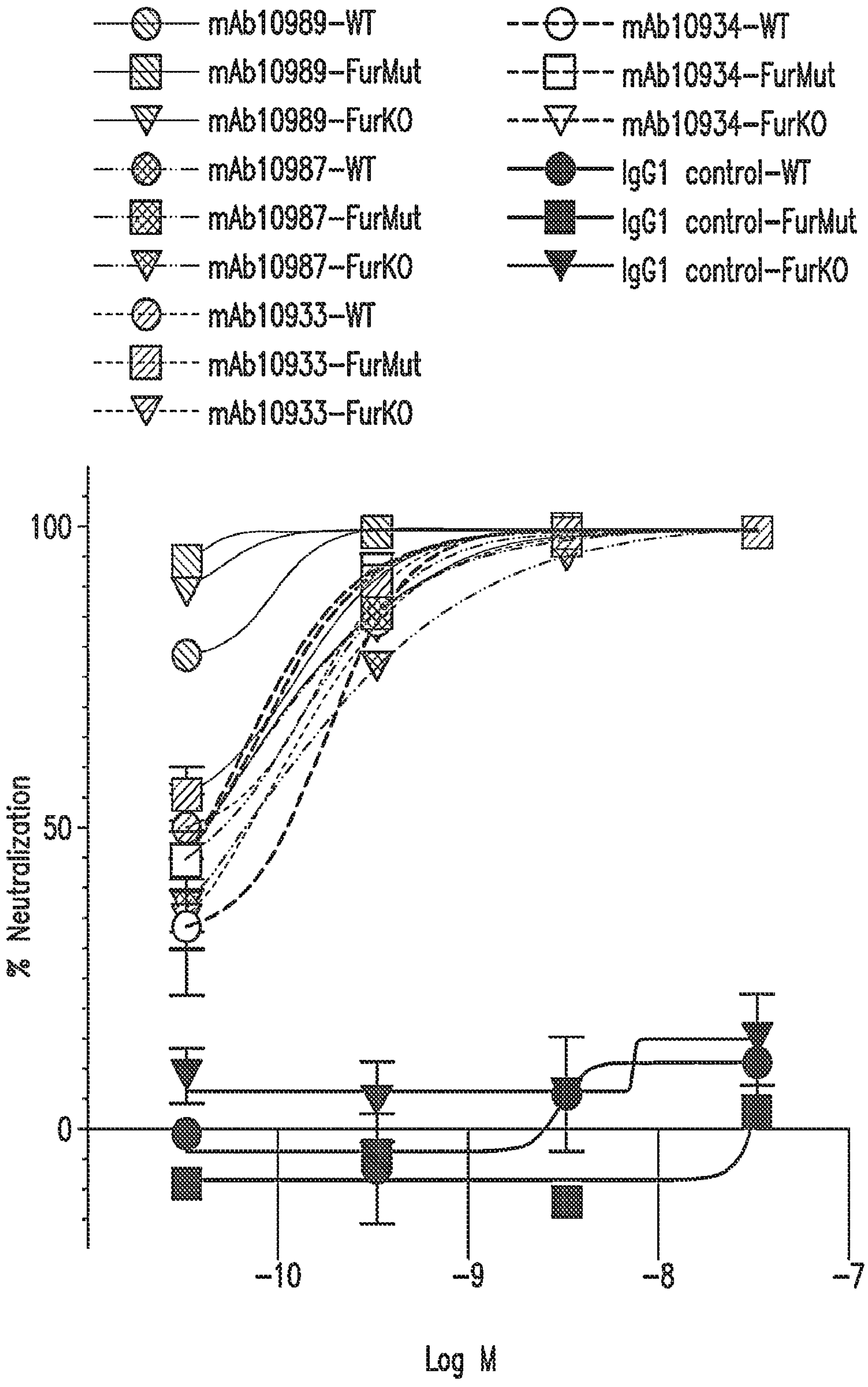
Figure 12C:
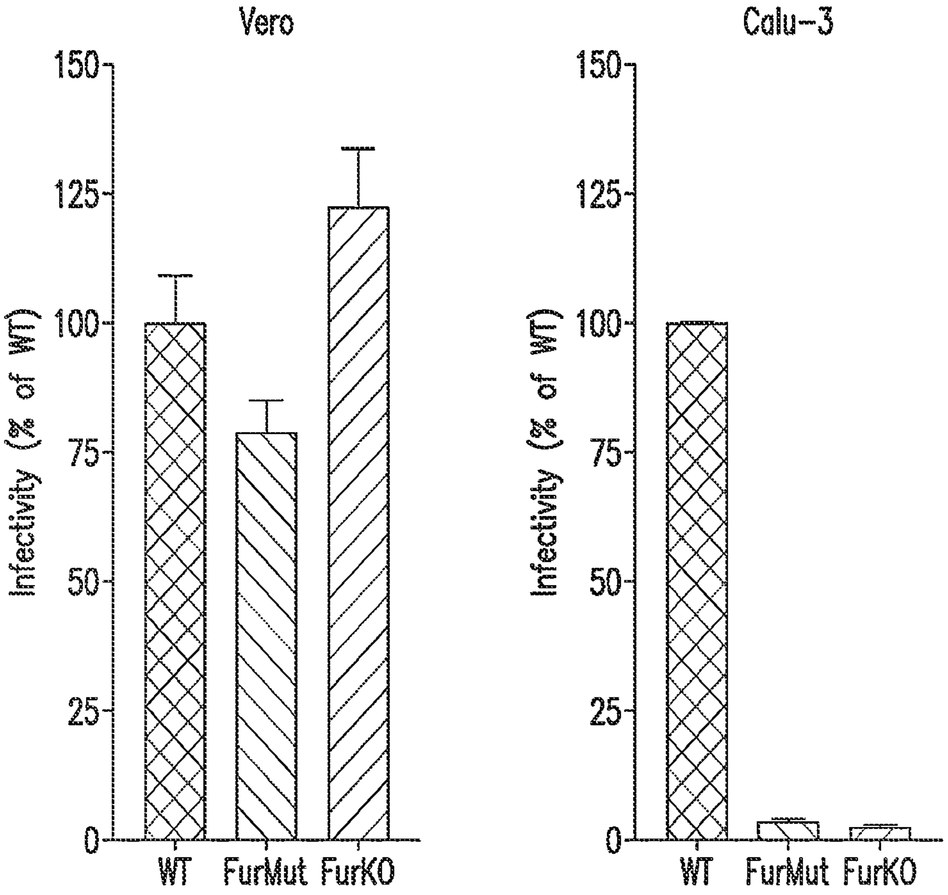
Figure 13:
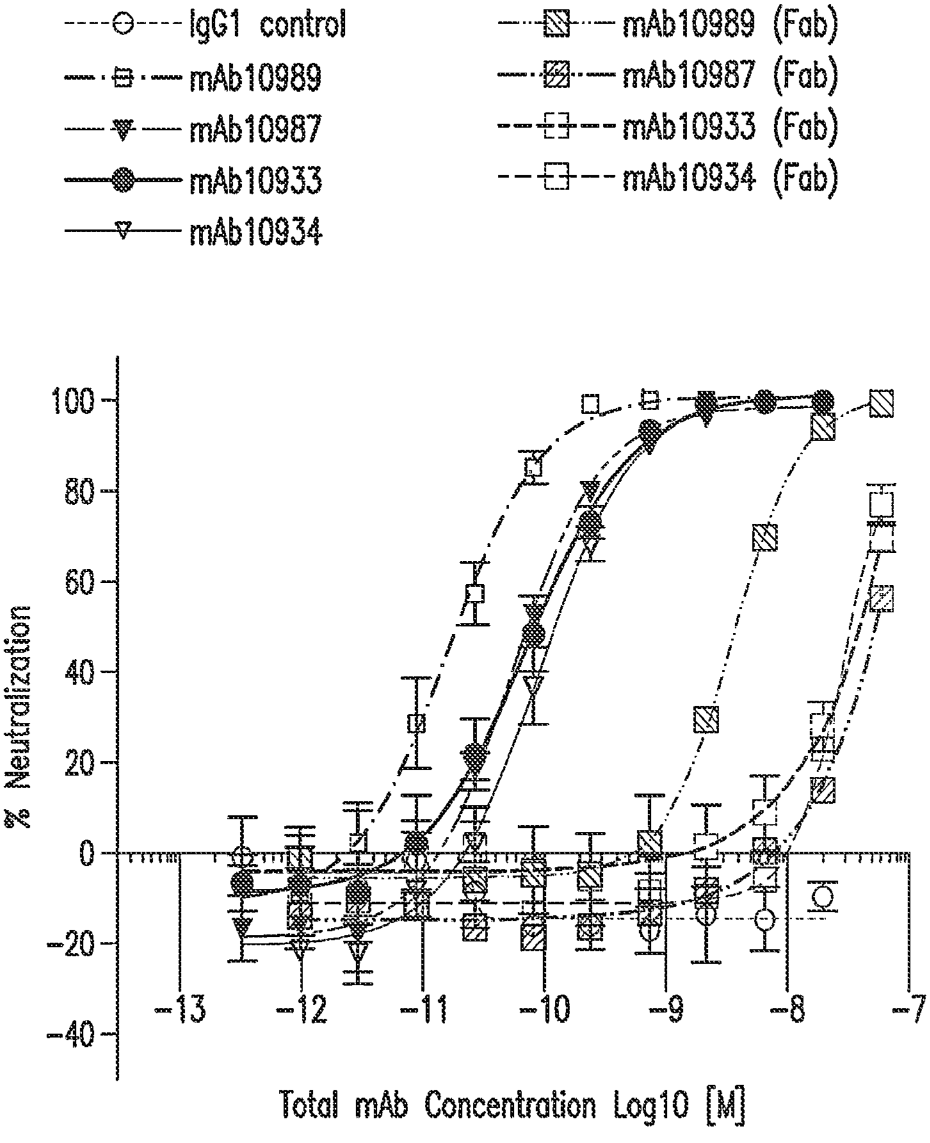
FIG. 13 displays neutralization potency of antigen-binding fragment (Fab) and full-length antibodies for VSV-spike pseudoparticles in Vero cells.

Example 18: Neutralization of Cleaved SARS-CoV-2 Spike Proteins and Neutralization with Fabs Because pseudoparticles containing the SARS-CoV-2 Spike may be pre-cleaved by furin-like proteases at the polybasic S1/S2 cleavage site during biogenesis in HEK293T cells, the impact of this cleavage on mAb neutralization potency was assessed. Spike stabilized pseudoparticles (FIG. 12A) with a monobasic cleavage site (FurMut) in the S1/S2 interface or deleted region (FurKO) were produced. No differences were observed in neutralization of either FurMut or FurKO containing pseudoparticles relative to wild-type (WT) in Vero cells (FIG. 12B). Interestingly, stabilized pseudoparticles had comparable or greater infectivity to those with WT cleavage sites in Vero cells, whereas dramatic loss of infectivity was observed in Calu-3 cells (FIG. 12C). SARS-CoV-2 with a natural deletion of the S1/S2 junction also has been observed to have defects in infectivity in Calu-3 cells, but not in Vero cells, implicating differential protease usage between these two cell types. To investigate the mechanism of neutralization, Fab fragments for these antibodies were generated. IgG antibodies were compared to the corresponding Fabs side-by-side for their ability to neutralize pseudotyped VSV (FIG. 13). The IC50s of all the Fabs was shifted compared to their parental IgG, indicating that bivalent binding, cross-linking and steric hindrance might all augment neutralization.

Example 19: Cross-Competition Between Anti-SARS-CoV-2-S mAbs mAb10987, mAb10989, mAb10933, and mAb10934 were examined in cross-competition binding assays (FIG. 14), identifying several pairs of non-competing mAbs with picomolar neutralization potency that could potentially be combined to form antibody cocktails, e.g., mAb10987 and mAb0933.

Epitope binning of the anti-SARS-CoV-2-S mAbs was conducted in a pre-mix sandwich format involving competing mAbs against one another in a pairwise combinatorial manner for binding to SARS-CoV-2 RBD-MMH protein using a ForteBio Octet HTX biolayer interferometry instrument (Molecular Devices ForteBio LLC, Fremont, CA) with running buffer of 10 mM HEPES, 150 mM NaCl, 0.05% (v/v) Tween-20, pH 7.4, 1 mg/mL BSA. Assays were performed at 30° C. with continuous agitation at 1000 rpm. After obtaining an initial baseline in running buffer 20 μg/mL of anti-COVID19 mAbs was captured onto anti-human Fc (AHC) biosensor tips for 300 s. To block remaining free unsaturated binding sites on AHC biosensor tips, all sensors were exposed for 240 s to blocking solution well containing 100 μg/mL irrelevant IgG1. Following this process, biosensors were immersed into wells containing pre-mix solution of 100 nM SARS CoV-2 RBD-MMH protein and 600 nM of anti-COVID19 mAb binding site of a second mAbs for 300 s. Binding response at each step was recorded and specific signal was normalized by subtracting self-blocking mAb competing control from dataset. Data analysis was performed with Octet Data Analysis HT 10.0 software using the Epitope Binning.

Comparing the cross-competition binding assays with the HDX-MS results described above provides structural insights into the mechanism by which non-competing pairs of antibodies can simultaneously bind the RBD, and can thus be ideal partners for a therapeutic antibody cocktail. mAb10987 and mAb10933 represent such a pair of antibodies. mAb10933 targets the spike-like loop region on one edge of the ACE2 interface. Within that region, the residues that show the most significant HDX protection by mAb10933 face upward, suggesting that the Fab region of mAb10933 binds the RBD from the top direction, where mAb10933 will have significant collisions with ACE2. In order to avoid competition with mAb10933, mAb10987 can only bind to the HDX-defined protected regions from the front or the lower left side (in the front view of mAb10987 in FIG. 15). This is consistent with the neutralization data described above, as mAb10987 would orient it in a position that has high probability to interfere with ACE2.

Example 20: Structure Determination of Antibody-Bound Spike Protein

To better understand the binding of mAb10933 and mAb10987 to the spike protein RBD, structural analysis was performed via cryo-electron microscopy (cryoEM). Fab fragments of mAb10933 and mAb10987 were isolated using FabALACTICA kit (Genovis). 600 μg of the mAb10933 Fab and 600 μg of mAb10987 Fab were mixed with 300 μg of SARS-CoV-2-S RBD and incubated on ice for ~1 hour then injected into a Superdex 200 increase gel filtration column equilibrated to 50 mM Tris pH 7.5, 150 mM NaCl. Peak fractions containing the mAb10933 Fab-mAb10987 Fab-RBD complex were collected and concentrated using a 10 kDa MWCO centrifugal filter. For cryoEM grid preparation, the protein sample was diluted to 1.5 mg/mL and PMAL-C8 amphipol was added. 3.5 μL of protein was deposited onto a freshly plasma cleaned UltrAufoil grid (1.2/1.3, 300 mesh). Excess solution was blotted away using filter paper and plunge frozen into liquid ethane using a Vitrobot Mark IV. The cryoEM grid was transferred to a Titan Krios (Thermo Fisher) equipped with a K3 detector (Gatan). Movies were collected using EPU (Thermo Fisher) at 105,000× magnification, corresponding to a pixel size of 0.85 Å. A dose rate of 15 electrons per pixel per second was used and each movie was 2 seconds, corresponding to a total dose of ~40 electrons per Å2.

All cryoEM data processing was carried out using cryoSPARC v2.14.2. 2,821 movies were aligned using patch motion correction and patch CTF estimation. 2,197 aligned micrographs were selected for further processing on the basis of estimated defocus values and CTF fit resolutions. An initial set of particles picked using blob picker were subjected to 2D classification to generate templates for template picking. 989,553 particles picked by template picking were subjected to multiple rounds of 2D classification to remove unbound fabs and particles containing an incomplete complex. Ab initio reconstruction with three classes generated a single class containing 61,707 particles that corresponded to the mAb10933 Fab-mAb10987 Fab-RBD complex. Heterogenous refinement of the particles in this class followed by non-uniform refinement resulted in a 3.9 Å resolution (FSC=0.143) map containing 48,140 particles that was used for model building. Into this map, we manually placed models of the RBD (taken from PDB code 6M17) and the two Fabs (taken from prior antibody structures, except for the lambda light chain of mAb10987 which came from PDB code 5U15). These models were then manually rebuilt using Coot and real-space refined against the map using Phenix.

Figure 16A:
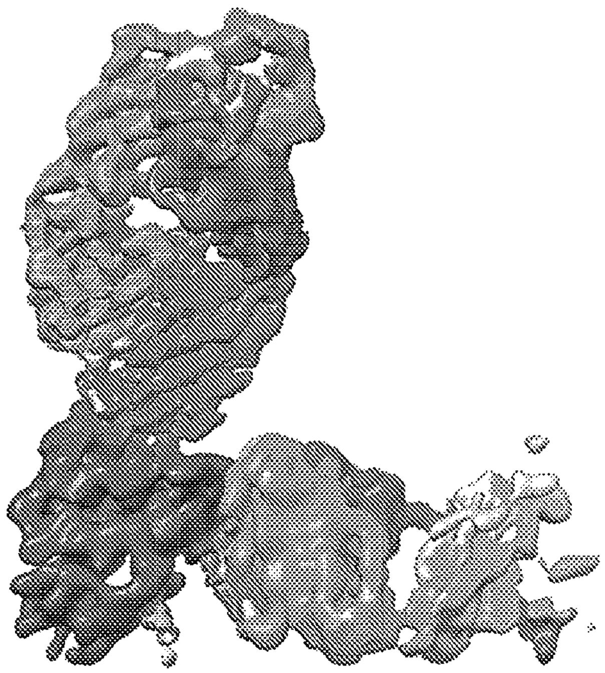
FIG. 16A and FIG. 16B display a complex of mAb10933 and mAb10987 with the SARS-CoV-2 RBD.
Figure 16B:
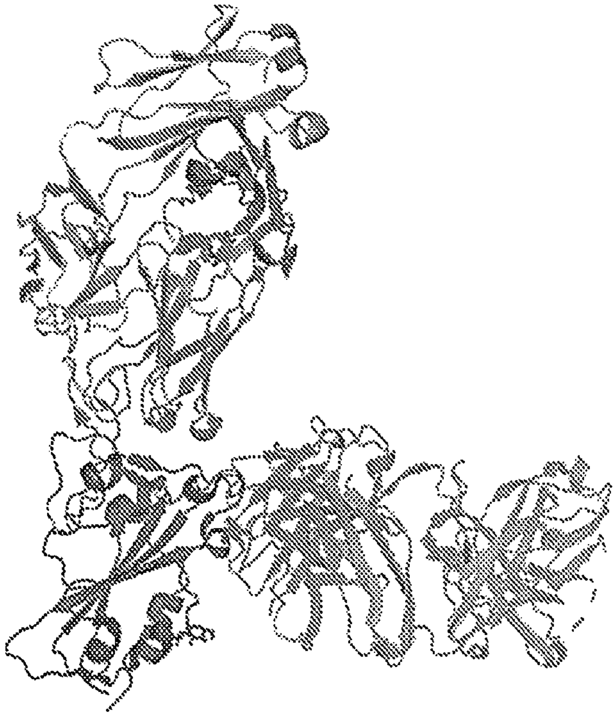

Confirming the above-described data, single-particle cryoEM of the complex of SARS-CoV-2 spike RBD bound to Fab fragments of mAb10933 and mAb10987 shows that the two antibodies in this cocktail can simultaneously bind to distinct regions of the RBD (FIG. 16 and FIG. 17). A 3D reconstructed map of the complex with nominal resolution of 3.9 Å shows that the both Fab fragments bind at different epitopes on the RBD, confirming that they are non-competing antibodies. mAb10933 binds at the top of the RBD, extensively overlapping the binding site for ACE2. On the other hand, the epitope for mAb10987 is located on the side of the RBD, well away from the mAb10933 epitope, and has little to no overlap with the ACE2 binding site.

Example 21: Protection Against the Emergence of Escape Mutants

Because rapidly emerging virus mutants are becoming the next major concern in the fight against the global pandemic, it is important that therapeutic treatments provide coverage against circulating variants and do not contribute to development of treatment emergent resistance. To this end, the sequence diversity of the spike protein was investigated and the emergence of minor virus variants was monitored in SARS-CoV-2 isolates found in nature or identified from preclinical in vitro and in vivo studies and in the clinic. A combination of non-competing antibodies not only provides full coverage against circulating variants but also protects against emergence of such variants and their potential seeding into the population in a clinical setting.

Although in vitro escape studies using recombinant viruses strongly support the rationale of using non-competing antibody combinations to avoid resistance, questions remain regarding the relevance of these findings to authentic SARS-CoV-2 virus, to in vivo infection models, and most importantly, to the clinical setting. In this example, in vitro escape variants were rapidly selected against all individual clinical stage-antibodies targeting the receptor binding domain (RBD) of the spike protein, independent of the targeted epitope or its degree of conservation, but this risk was mitigated by utilizing non-competing combinations of two non-competing antibodies, and even further reduced by combining three non-competing antibodies. Escape variants were also efficiently selected in vivo upon treatment with individual antibodies, in the hamster model of infection, independent of dosage or treatment setting (prophylaxis or therapy), while the combination of mAb10933 and mAb10987 fully protects against development of such resistance. Importantly, these findings were confirmed in humans: the genetic diversity of the entire spike protein across 4,882 samples from 1,000 outpatients or hospitalized patients with confirmed COVID-19 from ongoing Phase 1-3 trials was confirmed. Analysis of baseline and post-treatment sequence diversity in placebo and patients treated with mAb10933+mAb10987 demonstrated that the non-competing antibody combination protects against selection of spike protein resistant variants.

Figure 23A:
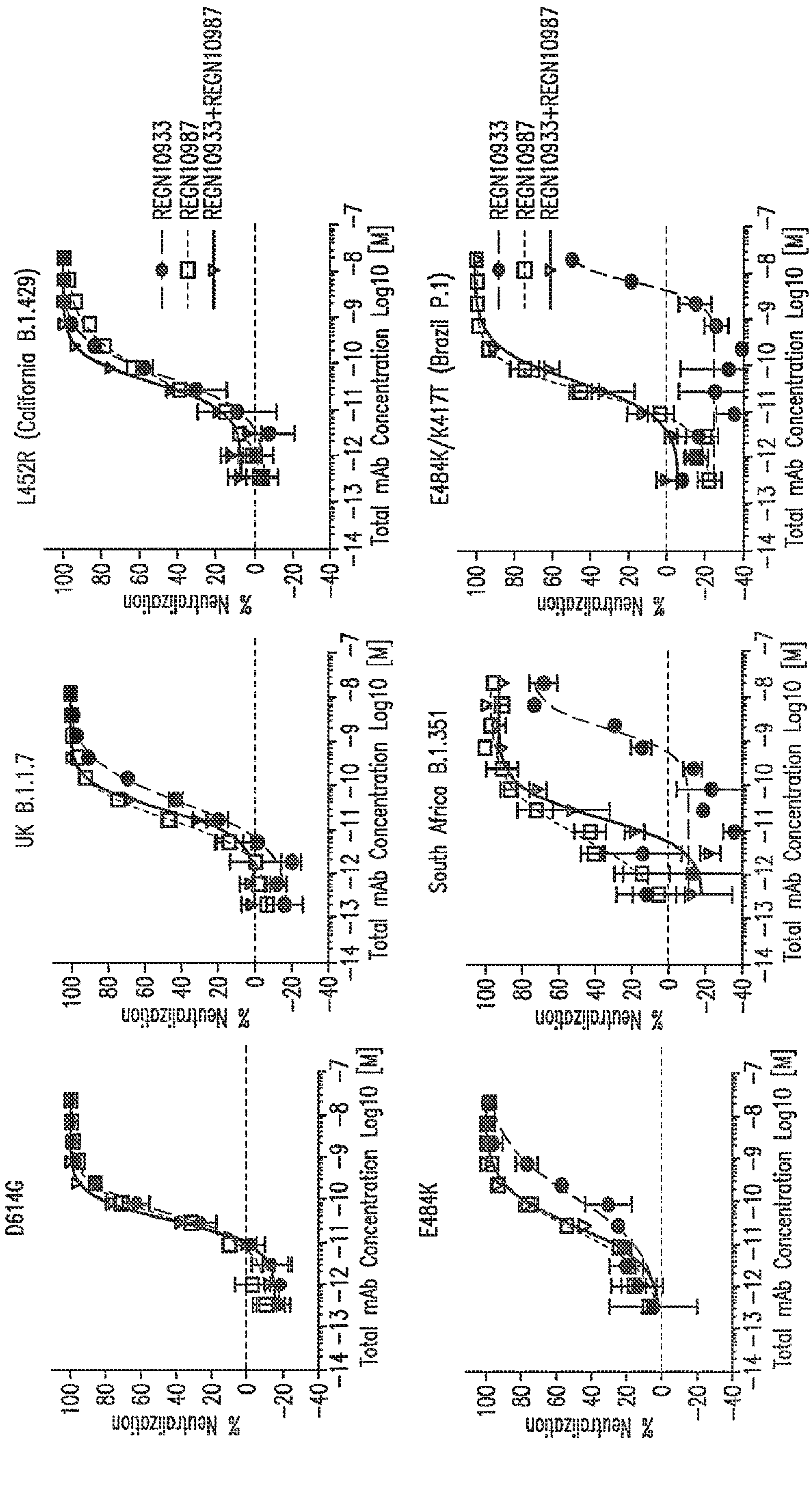

With the recent rise in rapidly emerging variants, there was a need to test the hypothesis that a non-competing antibody combination would retain its potency as the virus evolves during spread in the human population and safeguard against selection of escape mutants following treatment. This hypothesis was tested by evaluating the potency of individual antibodies as well as the combination of mAb10933 and mAb10987 against variants of concern, such as the UK B.1.1.7, California B.1.429, and E484K containing variants including South Africa B.1.351, Brazil P.1, and multiple other lineages around the world, such as the New York B.1.526 lineage. Even in instances where one of the antibodies was impacted, the combination retained full neutralization potency, a key property through which this combination of antibodies was originally selected (FIGS. 23A and 23B).

Materials and Methods

In Vitro Escape Studies and Neutralization Assays

Methods for pseudoparticle generation, neutralization assays, and escape studies have been previously described in detail above and in U.S. Pat. No. 10,787,501.

Neutralization Assays

Vesicular stomatitis virus (VSV) was pseudotyped with the SARS-CoV-2 spike protein and utilized for neutralization assays as previously described. In short, HEK293T cells (ATCC CRL-3216) were transfected with a SARS-CoV-2 spike expression plasmid encoding either wild-type (Wuhan-Hu-1) or variant spike protein. At 24 hours post transfection, the cells were then infected at an MOI of 1 with a modified VSV encoding a reporter construct in place of the native viral glycoprotein. The pseudoparticle containing supernatant was collected at 24 hours post infection and frozen at −80° C. before use. Neutralization assays were performed by infecting Vero cells (ATCC: CCL-81) with SARS-CoV-2 pseuduparticles preincubated with serial dilutions of antibody. Viral reporter signal was then read out at 24 hours post infection to determine the IC50 values for each antibody.

In Vitro Escape Studies

Escape studies were performed with recombinant VSV-spike virus. Antibodies were serially diluted 1:5 starting at 100 ug/mL. Virus replication was monitored by screening for cytopathic effect. The supernatants were collected from wells with the highest antibody concentration and evident viral replication. Total RNA was extracted from cells using TRIzol (Life Technologies) following the manufacturer's protocol for next gen sequencing. For a second round of selection, 100 uL of supernatant containing the virus was passed under the same or greater antibody concentrations as before. Again, the supernatants were collected, and RNA was extracted from cells in wells with the highest antibody concentration with evident viral replication and subjected to RNAseq analysis.

Hamster Study

A total of 80 golden hamsters, male, approximately 9 weeks of age (130-150 g) were used in the study. Animals were weighed prior to the start of the study. The animals were monitored twice daily for signs of COVID-19 disease (ruffled fur, hunched posture, responsiveness, nasal discharge, labored breathing, a.o.) during the study period. Body weights were measured once daily during the study period. Antibodies were dosed through intraperitoneal (IP) injection (0.200 ml volume). Animals were challenged with 1×10^4 PFU of (USA-WA1/2020 (NR-52281; BEI Resources) by administration of 0.05 ml total of viral inoculum, 0.025 ml dropwise into each nostril (mock exposed animals received the same volume of sterile PBS). Prior to treatment and virus administration, animals were sedated using inhalational isoflurane. At study end (day 7 post-challenge), animals were euthanized via inhalational $CO_2$ and tissues samples were aseptically collected for RNAseq. Tissue samples were inactivated using Trizol Reagent (Invitrogen, Carlsbad, CA, USA). All animal studies were conducted in compliance with all relevant local, state, and federal regulations and were approved by the Texas Biomed Institutional Animal Care and Use Committee (IACUC; protocol number 1739MA).

Clinical Trial Design

Outpatient Clinical Trial

This is an ongoing adaptive, multicenter, randomized, double-blind, placebo-controlled, seamless phase 1/2/3 clinical trial in COVID-19 outpatients (clinicaltrials.gov: NCT04425629). Non-hospitalized patients >18 years of age with a SARS-CoV2-positive test result <72 hours, and symptom onset <10 days before randomization, were randomized 1:1:1 to receive placebo, 2.4 g (1.2 g each of mAb10933 (casirivimab) and mAb10987 (imdevimab)) or 8.0 g (4.0 g each of casirivimab and imdevimab). The primary virologic endpoint was the time weighted average daily change in viral load from baseline (Day 1) through Day 7. The key secondary clinical endpoint was the proportion of patients with 1 or more Covid-19 related medically-attended visit (MAV) through Day 29. For the present work, 3523 nasopharyngeal, 17 nasal and 6 saliva samples retrieved from a total of 728 patients were analyzed.

Hospitalized Patient Clinical Trial

This is an ongoing adaptive, multicenter, randomized, double-blind, placebo-controlled, seamless phase 1/2/3 clinical trial in hospitalized patients with Covid-19 (clinicaltrials.gov: NCT04426695). Hospitalized patients >18 years of age with a SARS-CoV2-positive test result <72 hours, and symptom onset <7 days before randomization, were randomized 1:1:1 to receive placebo, 2.4 g (1.2 g each of casirivimab and imdevimab) or 8.0 g (4.0 g each of casirivimab and imdevimab). The primary clinical endpoint was the incidence of death or required mechanical ventilation through Day 29. For the present work, 968 nasopharyngeal, 249 nasal and 119 saliva samples retrieved from a total of 272 patients were analyzed.

Virus RNA, RT-PCR and Sequencing

Viral RNA was extracted from hamster samples and from samples collected in the clinical trials (Viracor-Eurofins, MO, USA). For clinical samples, qualitative and quantitative measurements of viral load were determined by quantitative RT-PCR (Viracor-Eurofins, MO, USA). 10 ul of RNA combined with 25 ng Human Universal Reference RNA (Agilent) was purified by PureBeads (Roche Sequencing). cDNA synthesis was performed using SuperScript™ IV First-Strand Synthesis System (Thermal Fisher) following vendor's protocol. Then one half of cDNA (10 ul) was used to generate libraries using Swift Normalase™ Amplicon Panel (SNAP) SARS-CoV-2 Panel (Swift Biosciences) following vendor's protocol. Sequencing was run on NextSeq (Illumina) by multiplexed paired-read run with 2×150 cycles. Overall quality report was generated summarizing the quality of all reads in each sample, along each base pair.

Variant Calling Analysis

Swift amplicon bulk RNA-seq reads were aligned to the SARS-CoV-2 reference genome Wuhan-Hu-1 (accession: MN908947) using Minimap2 (v2.17). The alignments were sorted by read name, and primers were clipped by the complementary Swiftbiosciences primerclip software (v0.3.8) (github.com/swiftbiosciences/primerclip). Duplicate reads were removed using the Picard package (https://github.com/broadinstitute/picard) and target coverage was summarized for each sample with custom scripts. GATK HaplotypeCaller (v4.1.8) was used to perform single nucleotide polymorphism (SNP) calling. At each SNP, the frequency of viral mutations inferred from the sequencing reads were calculated from samtools (v1.9) pileup output. Variants were flagged if nucleotide positions were covered by at least 10 reads and frequency of mutated reads at these positions was at least 15%.

Variant Calling from SARS-CoV-2 Public Genomes

Variant calling from SARS-CoV-2 public genomes was performed as described in Baum et al., Science 370(6520): 1110-1115 (2020). SARS-CoV-2 complete genome sequences were downloaded from GISAID Nucleotide database (https://www.gisaid.org) on Feb. 4, 2021. Sequences were curated and genetic diversity of the spike-encoding gene was assessed across high quality genome sequences using custom pipelines. In brief, Blastn was used to align the Wuhan-Hu-1 spike nucleotide sequence (accession: MN908947) against each individual genome. Results were analyzed and presence of the gene was validated if alignment length was greater than 95% with an identity percentage greater than 70%. Homologous spike protein sequences were extracted, translated and aligned to identify amino-acid changes with respect to the reference.

Results

Figure 24A:
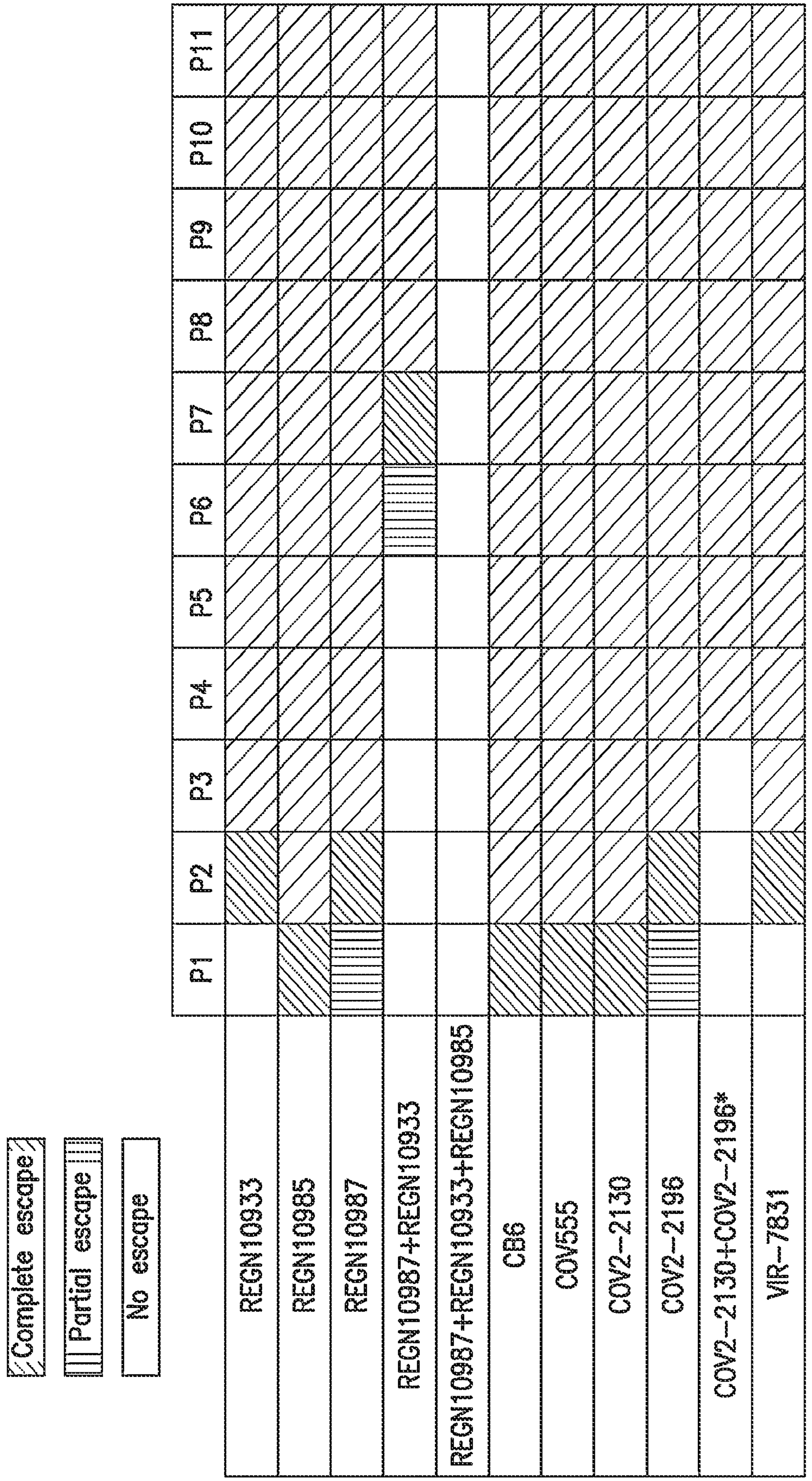

As shown above, combination therapy with two anti-spike antibodies targeting non-overlapping epitopes of SARS-CoV-2 spike protein minimizes the likelihood of rapid viral escape observed in vitro with monotherapy. Expanding on this work using VSV-SARS-CoV-2-spike recombinant virus to monitor resistance to mAb treatment, escape studies were performed with several RBD-targeting mAbs approved under Emergency Use Authorization or in clinical trials, as a monotherapy as well as double and triple combinations. While only one to two passages led to complete virus resistance against all mAbs used as monotherapy, seven consecutive passages were needed to reach complete resistance to the REGEN-COV combination, requiring multiple simultaneous mutations impacting each antibody (FIG. 24A and FIG. 24B). Escape variants identified with comparator antibodies COV2-2130, COV2-2196, CB6, and COV555 were consistent with previous reports. Similar to the mAb10933+mAb10987 (also referred to as REGEN-COV) combination, the COV2-2130 and COV2-2196 cocktail was also resistant to rapid escape (FIG. 24A).

Rapid escape observed in the monotherapy setting was independent of the targeted epitope or its sequence conservation; indeed, escape variants were rapidly selected against an antibody targeting a pan-coronavirus epitope, VIR-7831 (FIG. 24A and FIG. 24B). All VIR-7831 escape residues mapped to the published epitope of the antibody and the resultant escape virus maintained its ability to replicate, indicating that these mutations were not deleterious to the virus. Furthermore, the identified escape variants can be found in publicly available genome sequences (GISAID), indicating that they are tolerated by the authentic SARS-CoV-2 virus and are likely to be selected under pressure. These experiments highlight the inherent risk of monotherapy against SARS-CoV-2 with any anti-spike mAb, regardless of the targeted epitope or its conservation.

Figure 24C:
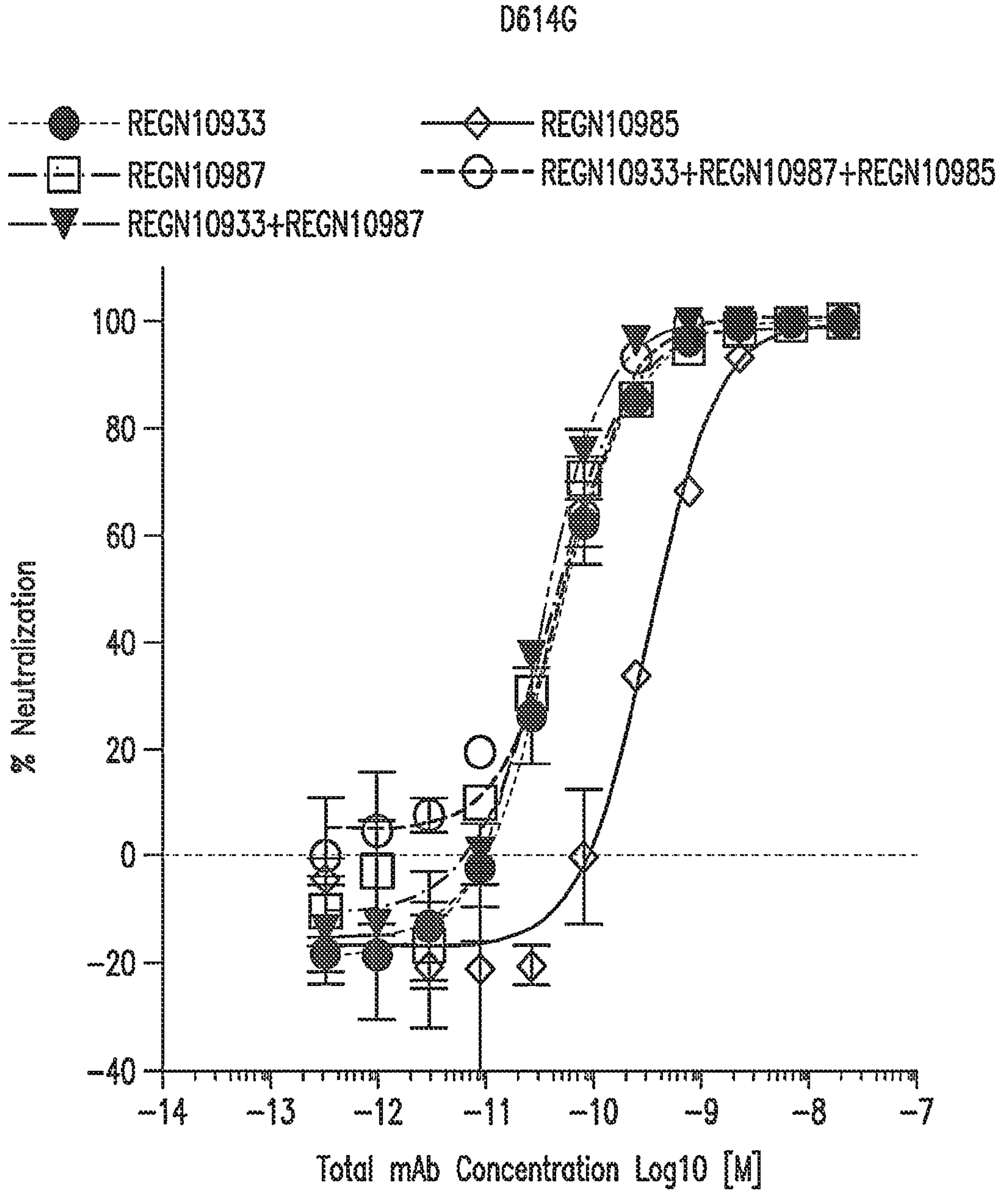
Figure 24D:
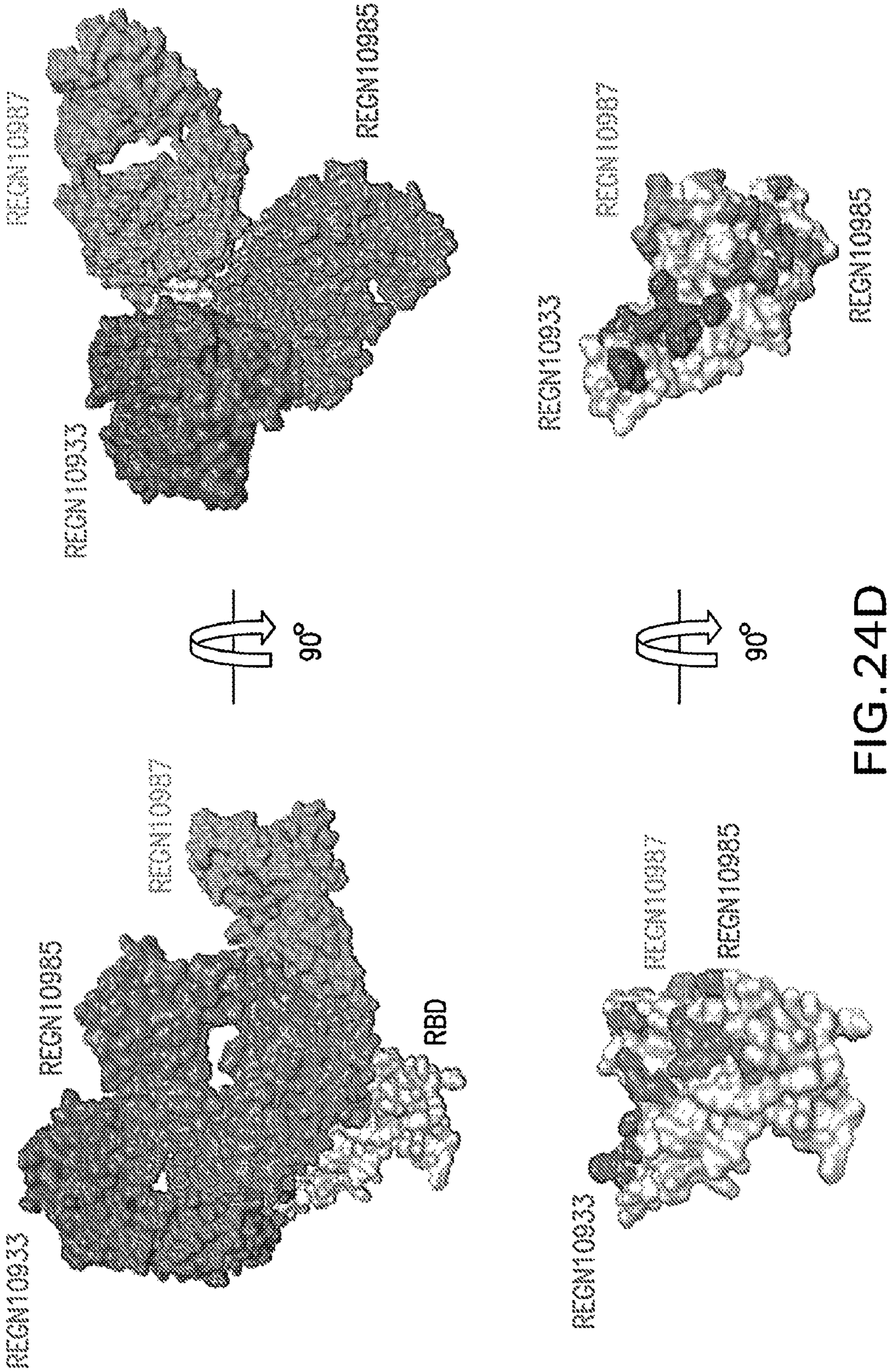

There are potential advantages of combining three non-competing neutralizing mAbs targeting the RBD of SARS-CoV-2 (mAb10933+mAb10987+mAb10985). The three mAbs are all able to bind simultaneously to the RBD of the spike protein in a non-overlapping fashion and the combination has similar neutralization potency as REGEN-COV (FIG. 24C and FIG. 24D). The addition of the third non-competing RBD mAb (mAb10985) further increased protection against viral escape, with no loss of antiviral potency observed through eleven consecutive passages (FIG. 24A and FIG. 24B). These results demonstrate that a three mAb neutralizing non-competing combination targeting the spike RBD provides a potential further advantage as a SARS-CoV-2 therapeutic.

Figure 25A:
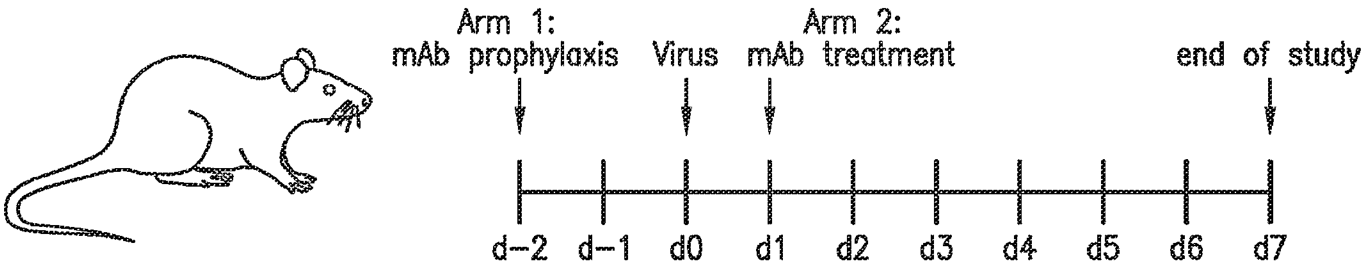
FIG. 25A, FIG. 25B, and FIG. 25C display the frequency of SARS-CoV-2 spike variants identified in viruses from lungs of hamsters treated with either REGN10987 or REGN10933 as monotherapy or with the REGEN-COV combination in both prophylactic and treatment settings.
Figure 25B:
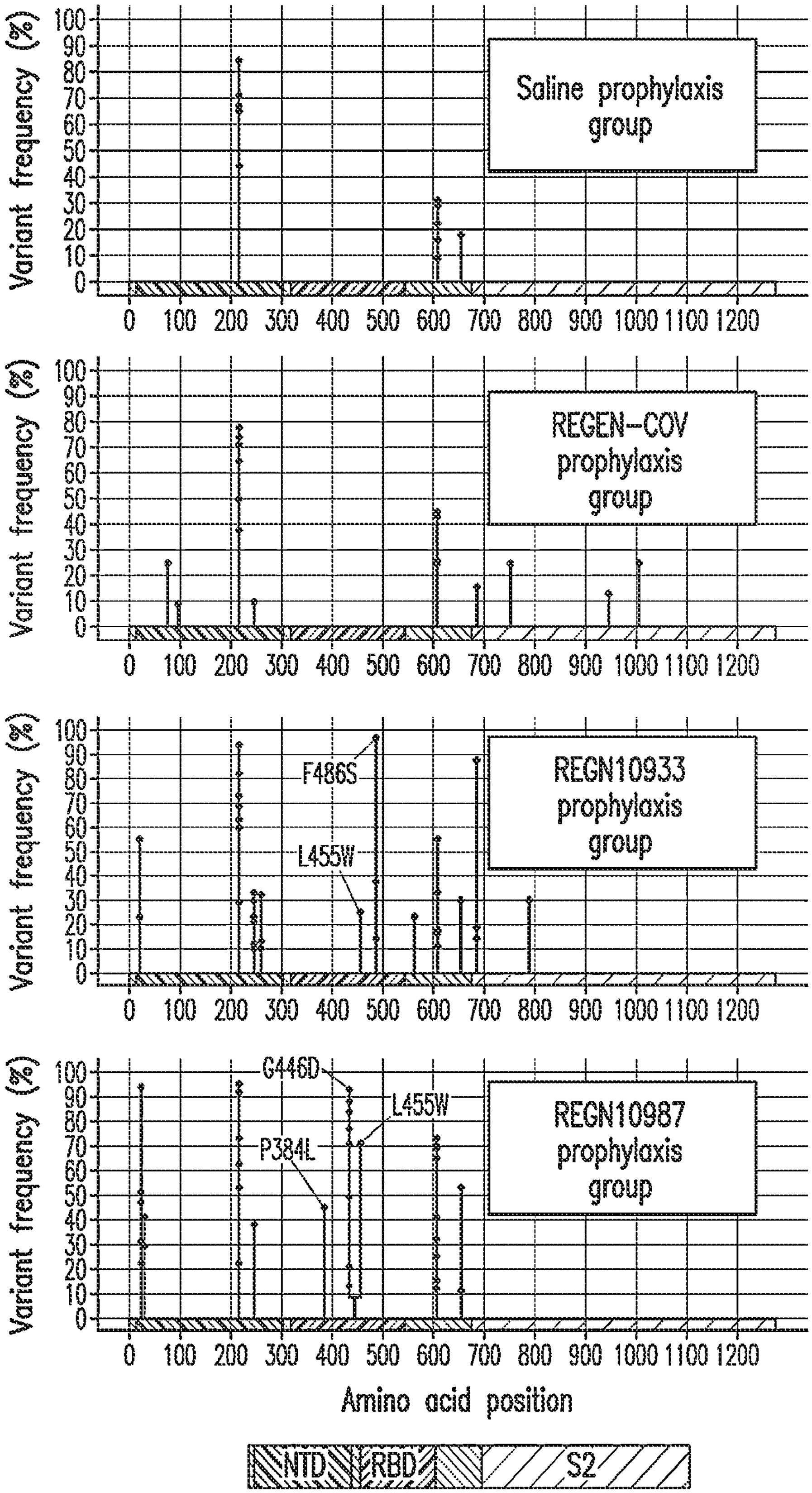
Figure 25C:
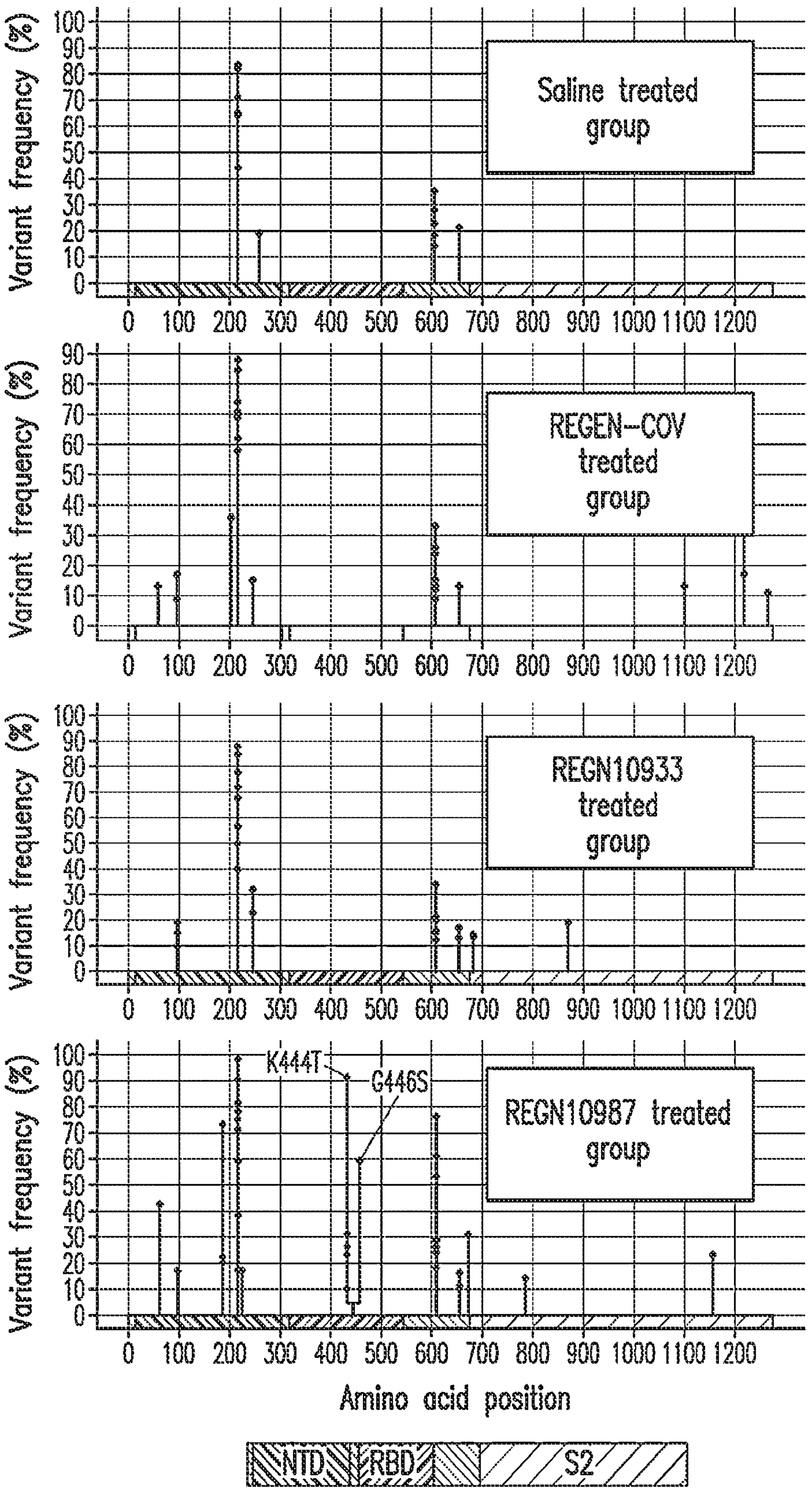

To understand how these in vitro escape findings demonstrated that mAb combination treatments safeguard against development of drug resistance translate to a more physiological setting, virus evolution was evaluated in vivo following mAb administration as both monotherapy (mAb10987 or mAb0933) and as the REGEN-COV combination in the SARS-CoV-2 hamster challenge model. Animals were challenged with SARS-CoV-2 (USA-WA1/2020) and treated with either high or low dose (50 mg/kg or 5 mg/kg) of either mAb10987 or mAb10933 as monotherapy or with the REGEN-COV combination (50 mg/kg or 5 mg/kg) in both prophylactic and treatment settings (FIG. 25A). These doses were previously shown to provide partial or complete efficacy in this animal model with REGEN-COV. Lungs from infected animals were collected on day 8 post-challenge to isolate viral RNA. RNAseq analysis was used to detect variants in the spike protein present even at low frequencies in the virus population (>15%). To identify putative treatment resistant variants, the analysis focused on the spike RBD, where the REGEN-COV antibodies are known to bind, and where all previously identified resistant variants to either antibody are located. Analysis of the RBD sequence in saline treated animals did not reveal any variants, indicating that in the absence of treatment the virus was not under strong selective pressure in this model (FIG. 25B and FIG. 25C). However, several variants in the RBD were identified in animals treated with either of the single antibodies as monotherapy (FIG. 25B and FIG. 25C). Remarkably, the analysis demonstrated selection of resistance variants in almost half (18/40) of monotherapy treated animals versus none (0/20) of the animals treated with the REGEN-COV cocktail. Out of the 7 RBD variants identified in monotherapy treated animals, 6 have been previously described as resistance variants or mapped to the same amino acid position as other resistance variants to either mAb10933 or mAb10987 (FIG. 34). Four of these variants were identified in in vitro escape studies, validating the relevance of using VSV-SARS-CoV-2-spike recombinant virus to identify SARS-CoV-2 escape mutations. Interestingly, variant selection occurred with monotherapy treatment in both the prophylactic and therapeutic settings, and both in low and high dose groups.

To assess the emergence of drug resistance in REGEN-COV treated COVID-19 patients, the genetic diversity of 1,336 and 3,546 SARS-CoV-2 RNA samples isolated from 272 hospitalized and 728 non-hospitalized individuals, respectively, was characterized at baseline and several time points post mAb cocktail administration (FIG. 30). In both hospitalized and non-hospitalized study groups, patients were randomly assigned (1:1:1) to receive placebo, 2.4 g of REGN-COV2, or 8.0 g of REGN-COV2, and patient samples were collected at multiple time points from baseline (day 1) to study end point (day 29). RNA-seq analysis was performed to characterize the genetic diversity of the spike sequence from all swabs positive for SARS-CoV-2 RNA by qRTPCR. Minor variants present at a frequency of at least 15% in the virus population were identified. In total, 244 and 514 amino acid changes were identified across all samples from hospitalized and non-hospitalized patients, respectively. For both studies, variant counts and frequencies in all three treatment groups were similar, indicating that REGEN-COV did not increase spike protein diversity relative to placebo (FIG. 30).

Figure 26A:
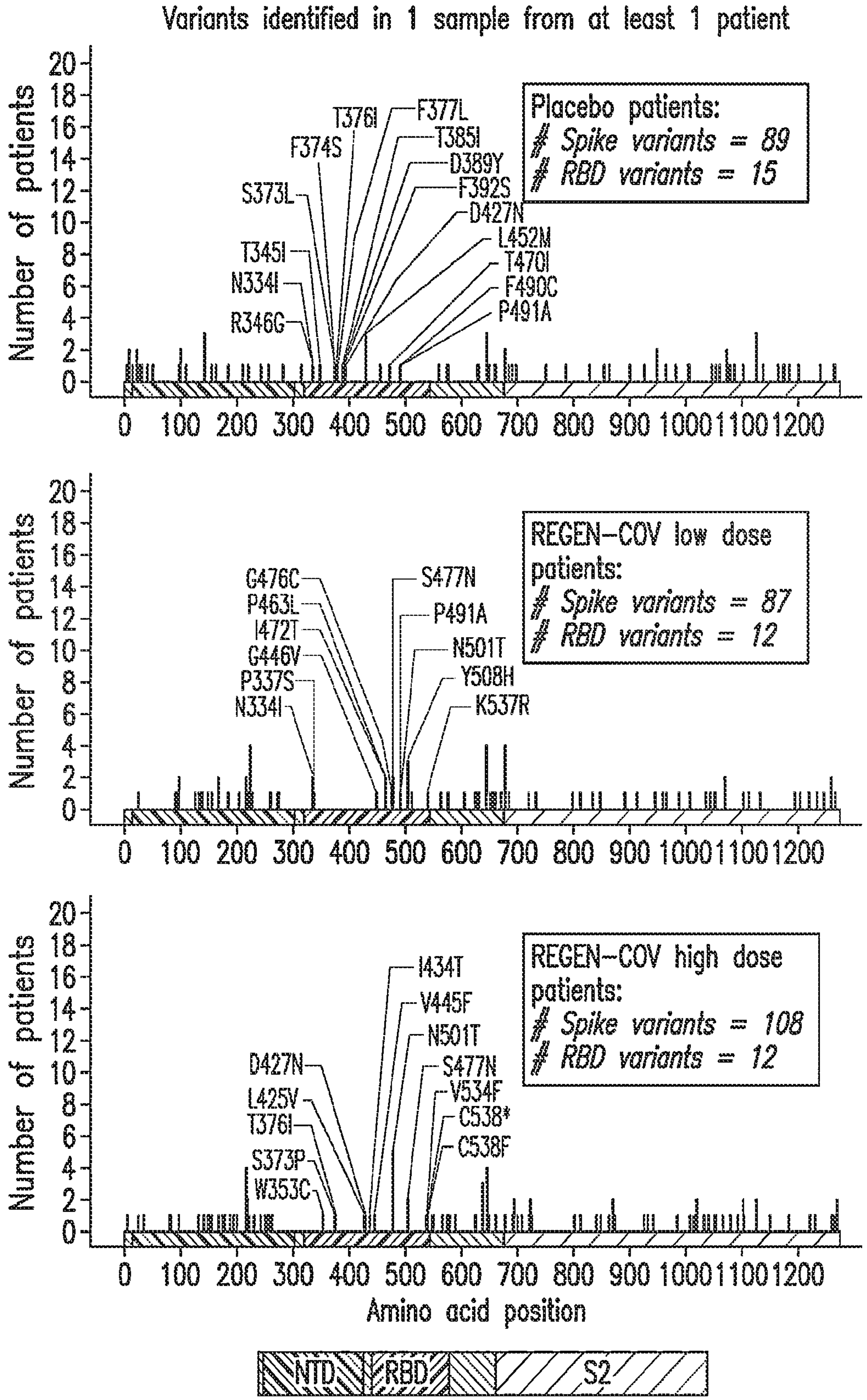
FIG. 26A and FIG. 26B display variant analysis of virus sequences in SARS-CoV-2 positive samples from hospitalized patients. Graphs show the distribution of amino acid variants across the spike protein sequence identified in samples from the placebo, REGEN-COV low-dose and REGEN-COV high-dose treated patients. Mutated sites are indicated with arrows and arrow length designates the number of patients with 1 or more variant-containing samples. All amino acid changes in RBD are labeled.
Figure 26B:
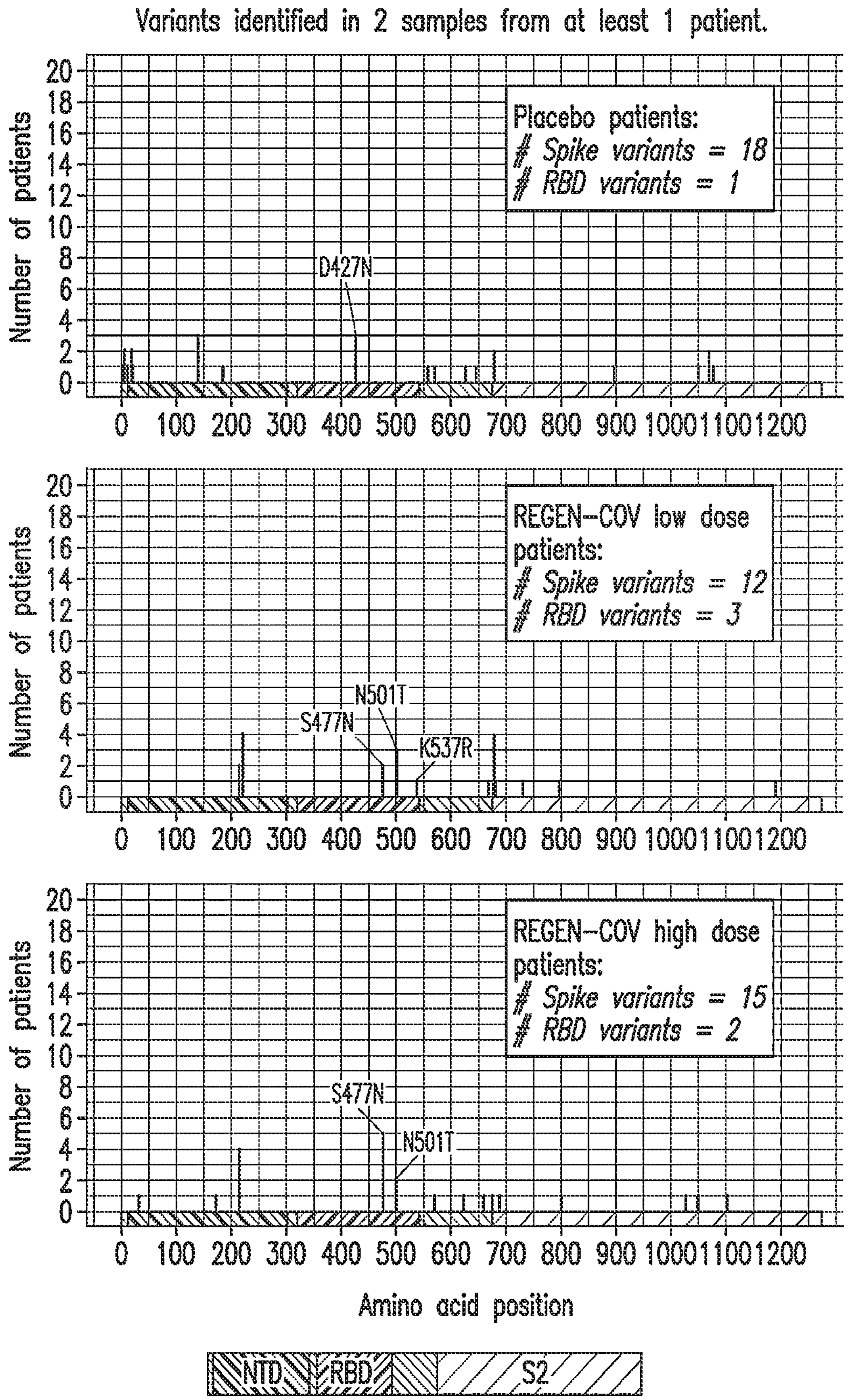
Figure 27A:
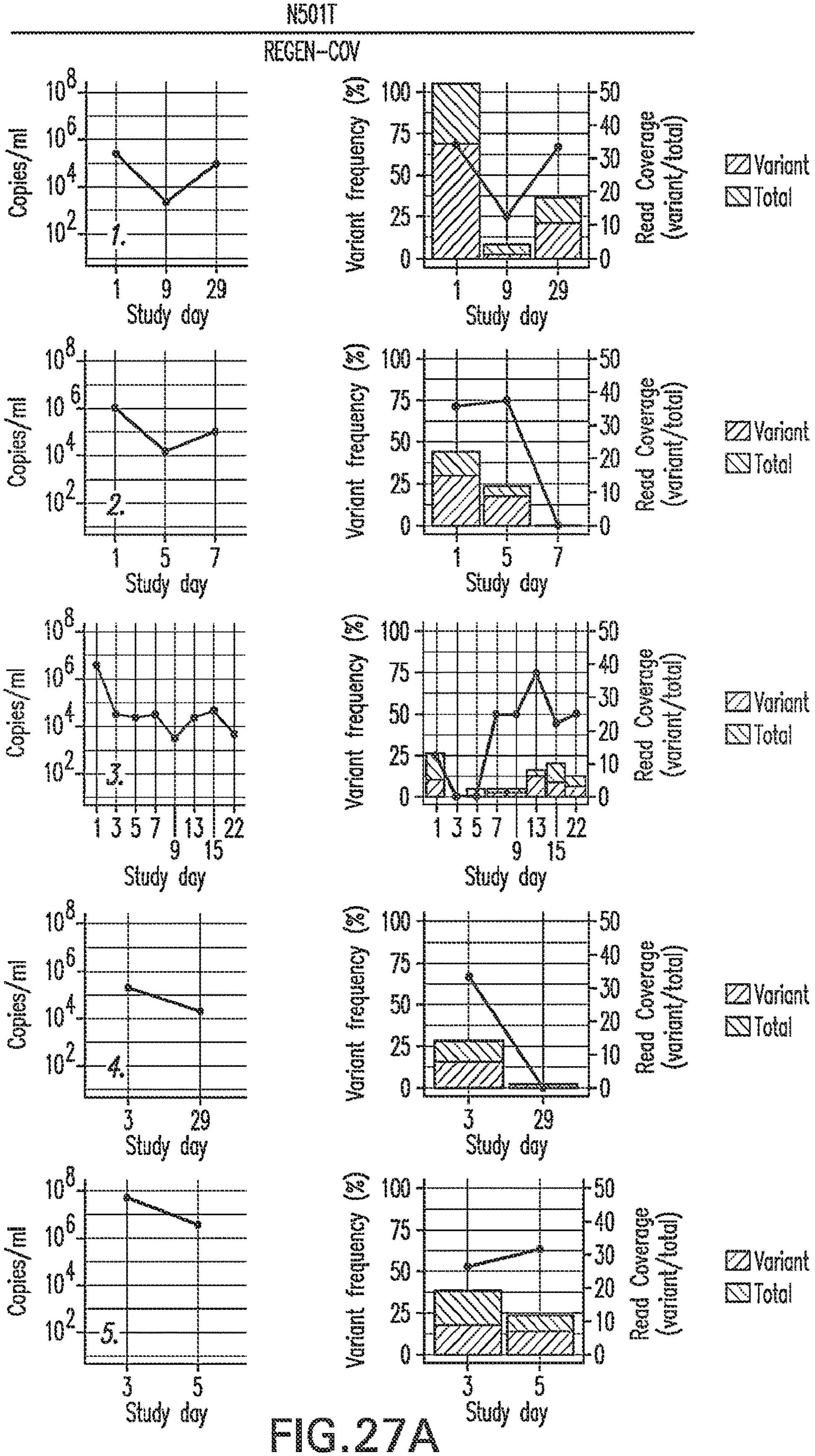
FIG. 27A and FIG. 27B display viral load and longitudinal frequencies of variants in REGN-COV2-treated, SARS-CoV-2 positive samples from hospitalized patients. Viral load was determined by quantitative RT-PCR.
Figure 27B:
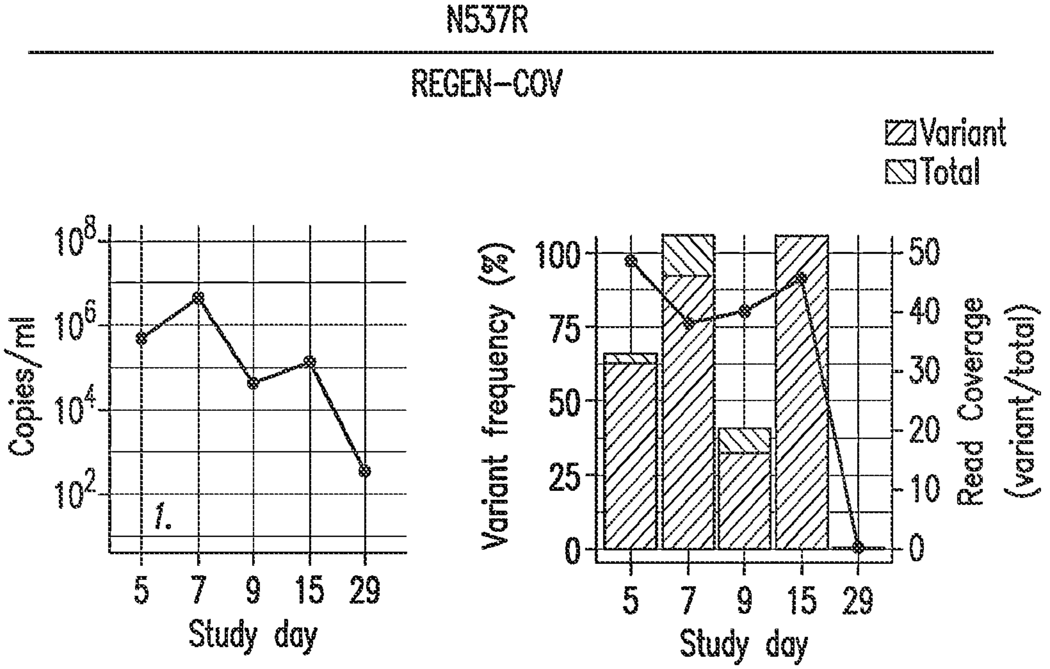
Figure 31A:
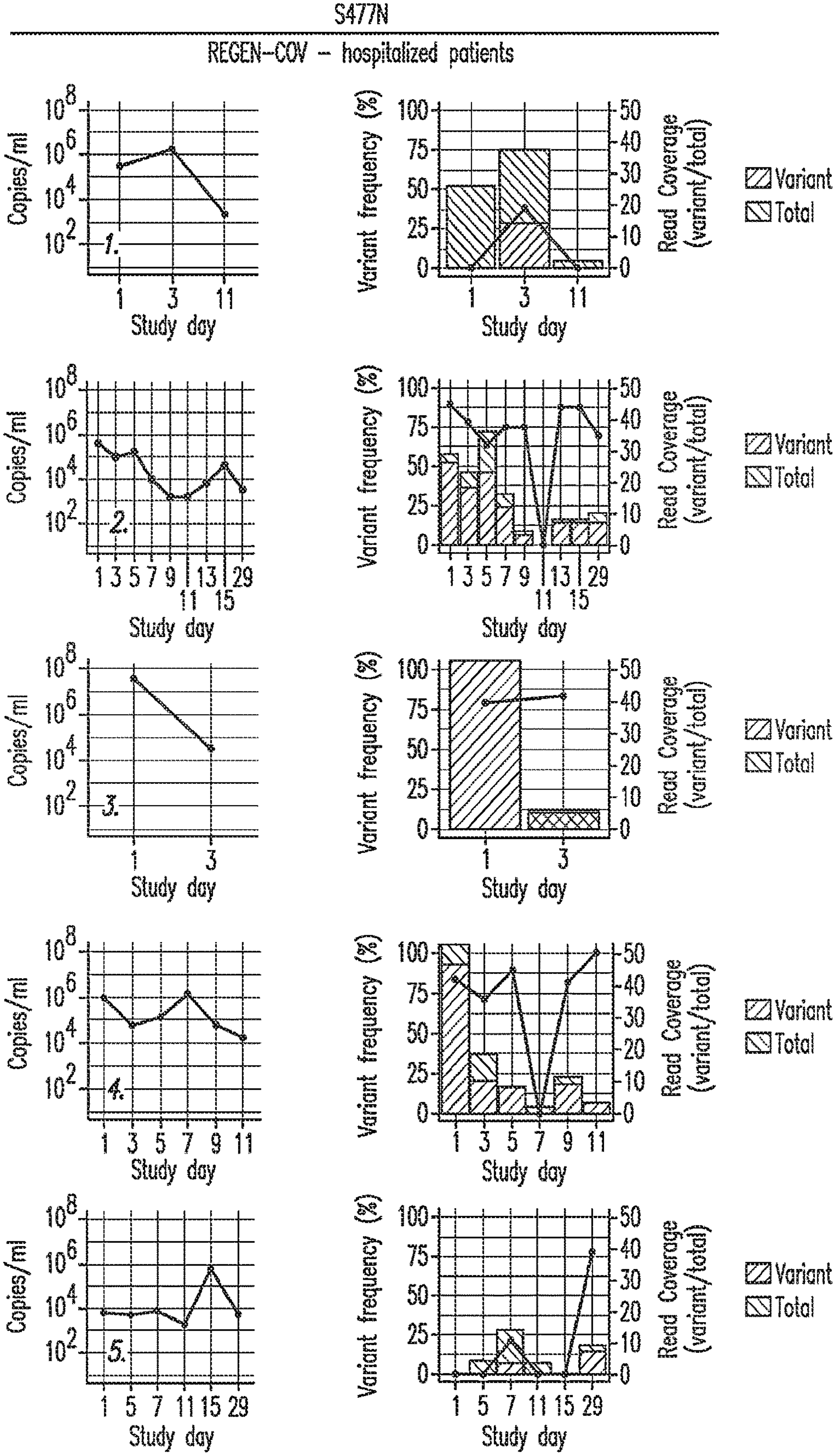
FIG. 31A and FIG. 31B show viral load and longitudinal frequencies of S477N in SARS-CoV-2 positive samples from hospitalized patients. Viral load was determined by quantitative RT-PCR. Variant frequencies are indicated by the black line as percent of reads with nSNPs relative to total number of covering reads. Histograms show total and mutated read coverage at variant position.
Figure 31B:
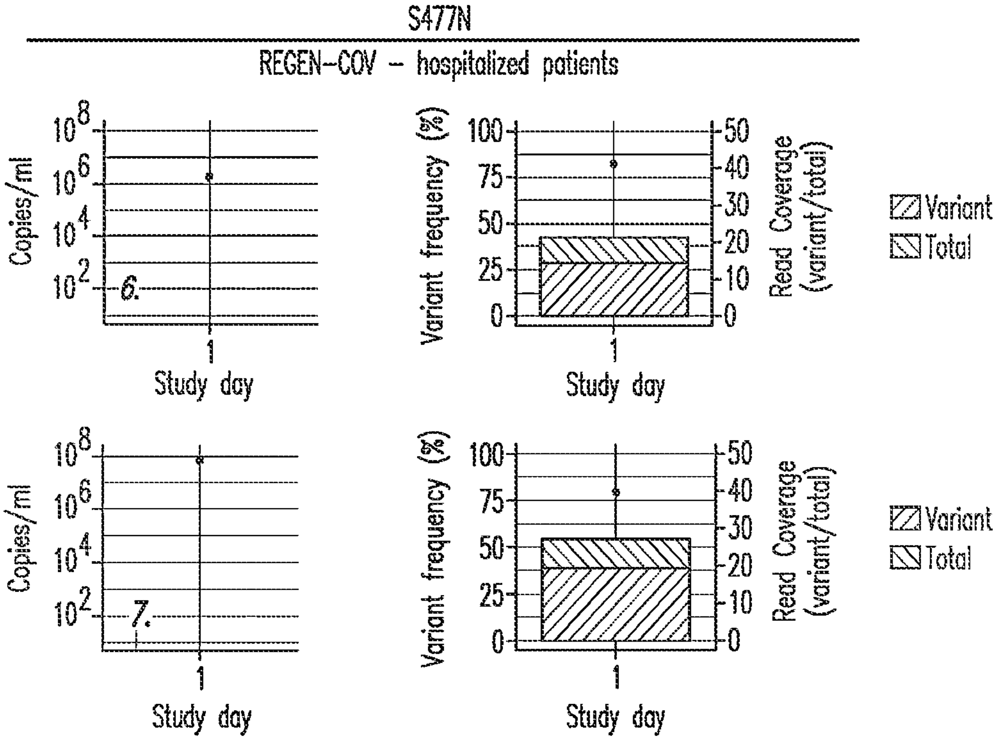

To determine whether REGEN-COV treatment contributed to selection of resistant variants in the spike protein, the frequency of minor variants in each patient from all available RT-PCR positive samples was longitudinally compared. Among all patient samples from the hospitalized group, a total of 89, 87 and 108 amino acid changes were identified in the placebo, low-dose and high dose treated groups, respectively. These mutations were evenly spread across the entire spike protein sequence (FIGS. 26A and 26B). The low number of variants in the RBD found among samples from patients treated with REGEN-COV further demonstrated lack of treatment emergent selection relative to placebo (15 RBD variants in placebo versus 12 low-dose/12 high-dose in REGEN-COV treated group). Only 17% (42/244) of all amino acid changes were observed at more than one time point in at least one patient (FIG. 26B) indicating that the vast majority of variants were lost over time likely as a result of lack of fitness or population bottlenecks. Three of these variants were found in the RBD in the REGEN-COV treated groups only (S477N, N501T and K537R). The S477N variant was present in 7 REGEN-COV treated patients at multiple time points, including baseline (FIGS. 31A and 31B). S477N is a common SARS-CoV-2 variant present at a frequency of >5% viruses circulating worldwide (source: GISAID). K537R was identified in 1 treated patient and is a rare mutation, which has been found in only <10 virus isolates worldwide to date (FIGS. 27A and 27B, source: GISAID). N501T was observed in 3 treated patients in this study (FIGS. 27A and 27B). Of note, in all patients, the three variants were identified at baseline or earliest time points (<5 days after REGEN-COV treatment) and no significant increase in their frequencies between early and late time points were observed indicating absence of treatment related selection.

Figure 28A:
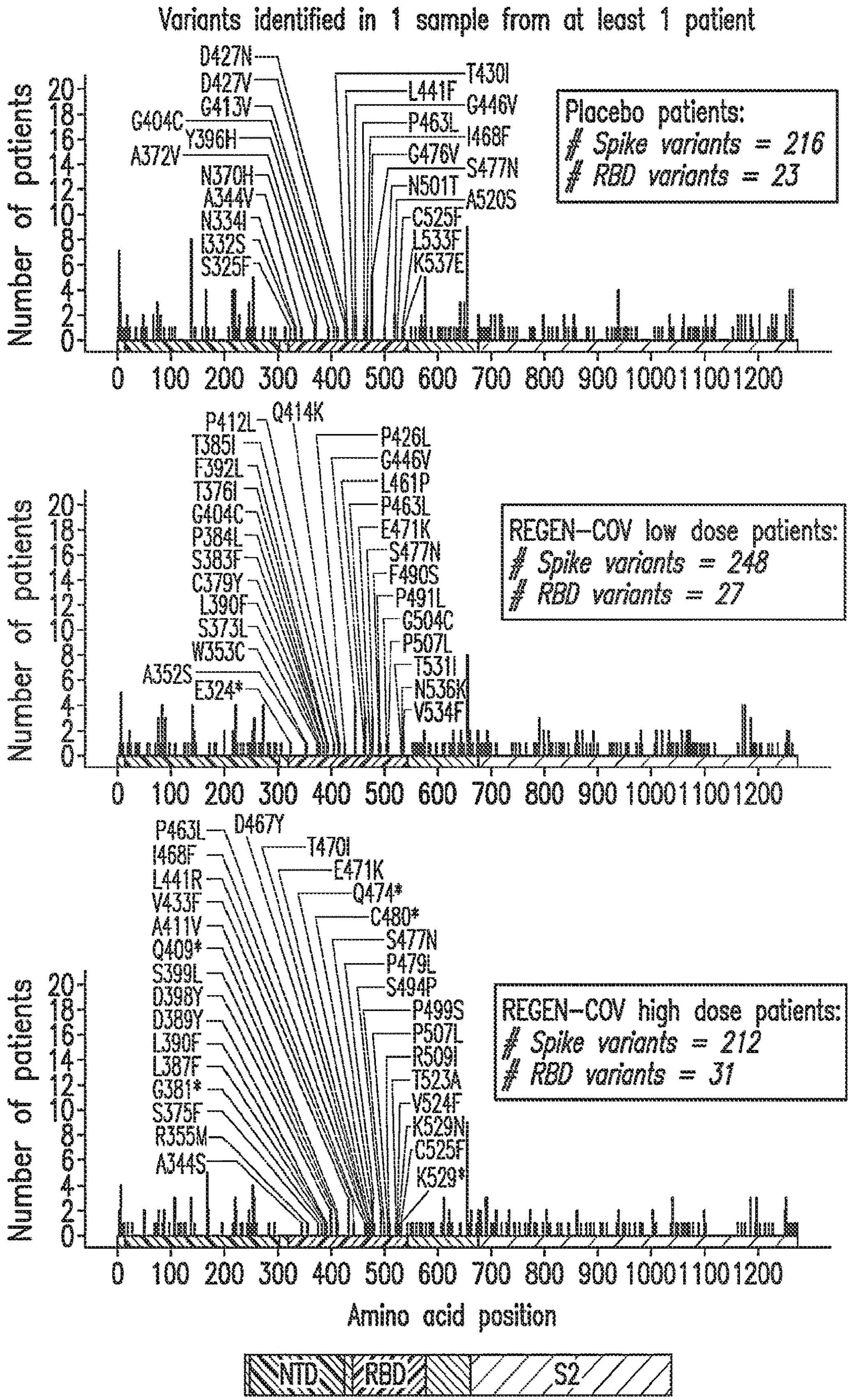
FIG. 28A and FIG. 28B: variant analysis of virus sequences in SARS-CoV-2 positive samples from non-hospitalized patients. Graphs show the distribution of amino acid variants across the spike protein sequence identified in samples from the placebo, REGENCOV low-dose and REGEN-COV high-dose treated patients. Mutated sites are indicated with arrows and arrow length designates the number of patients with 1 or more variant-containing samples. All amino acid changes in RBD are labeled.
Figure 28B:
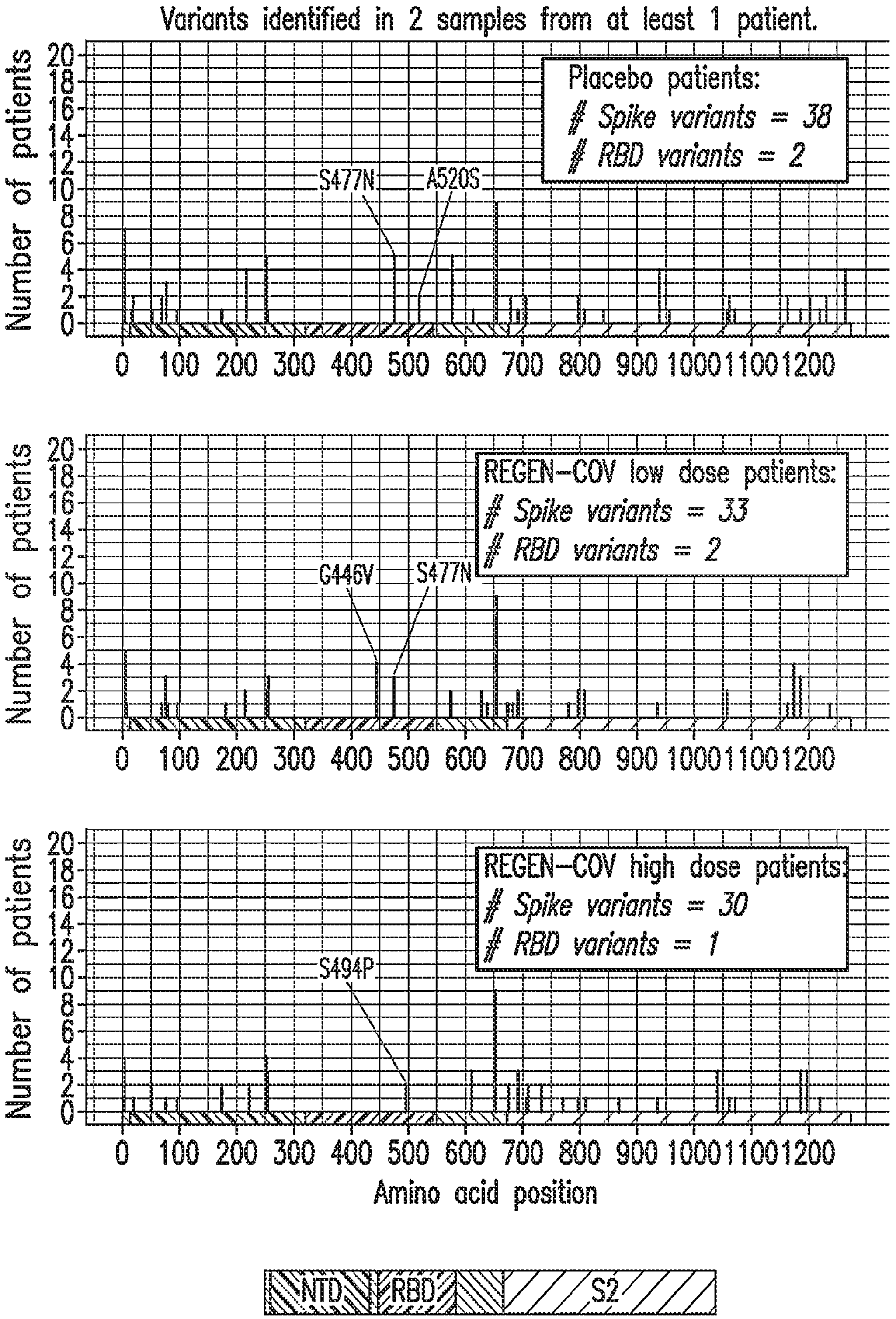
Figure 32A:
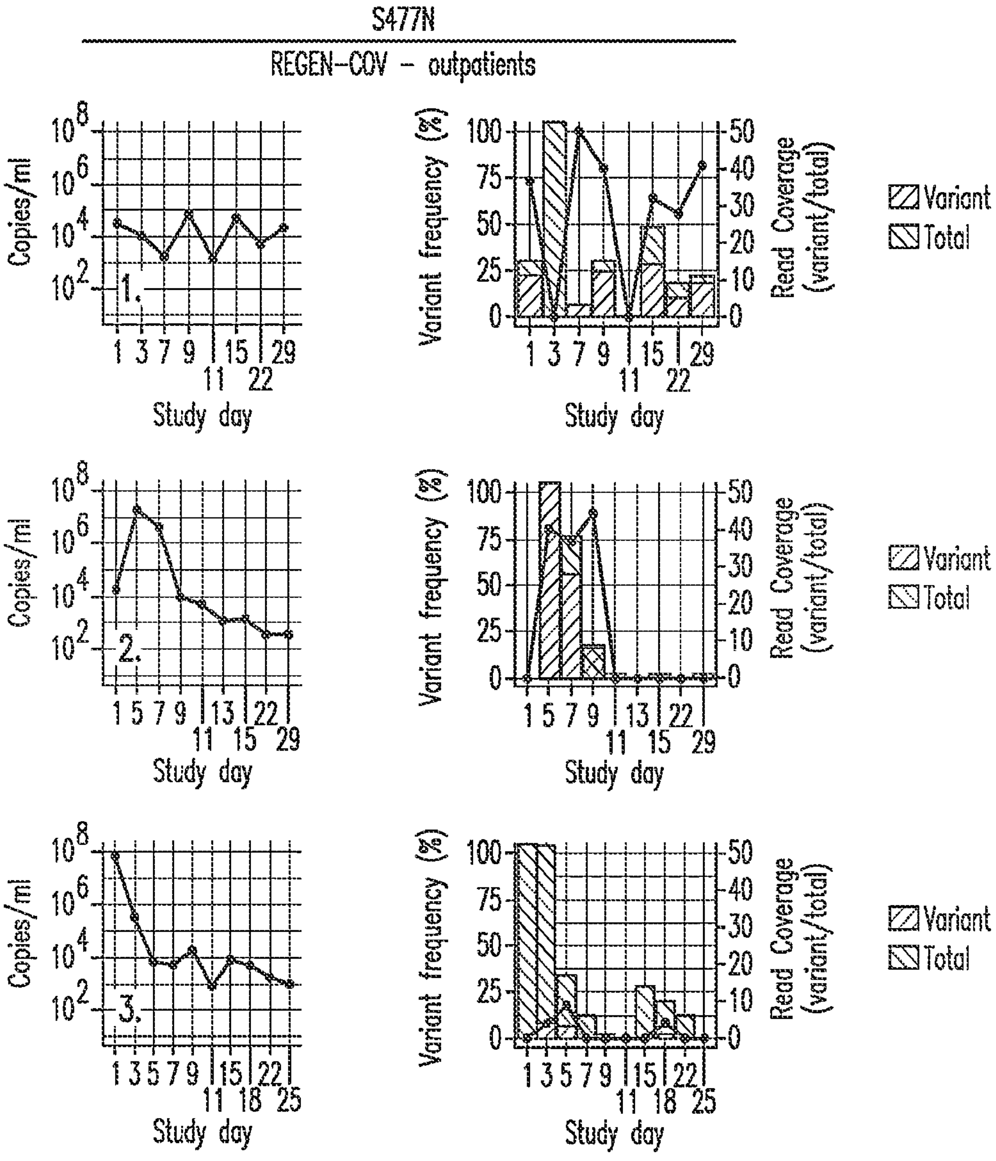
FIG. 32A and FIG. 32B show viral load and longitudinal frequencies of S477N in SARS-CoV-2 positive samples from non-hospitalized patients. Viral load was determined by quantitative RT-PCR. Variant frequencies are indicated by the black line as percent of reads with nSNPs relative to total number of covering reads. Histograms show total and mutated read coverage at variant position.
Figure 32B:
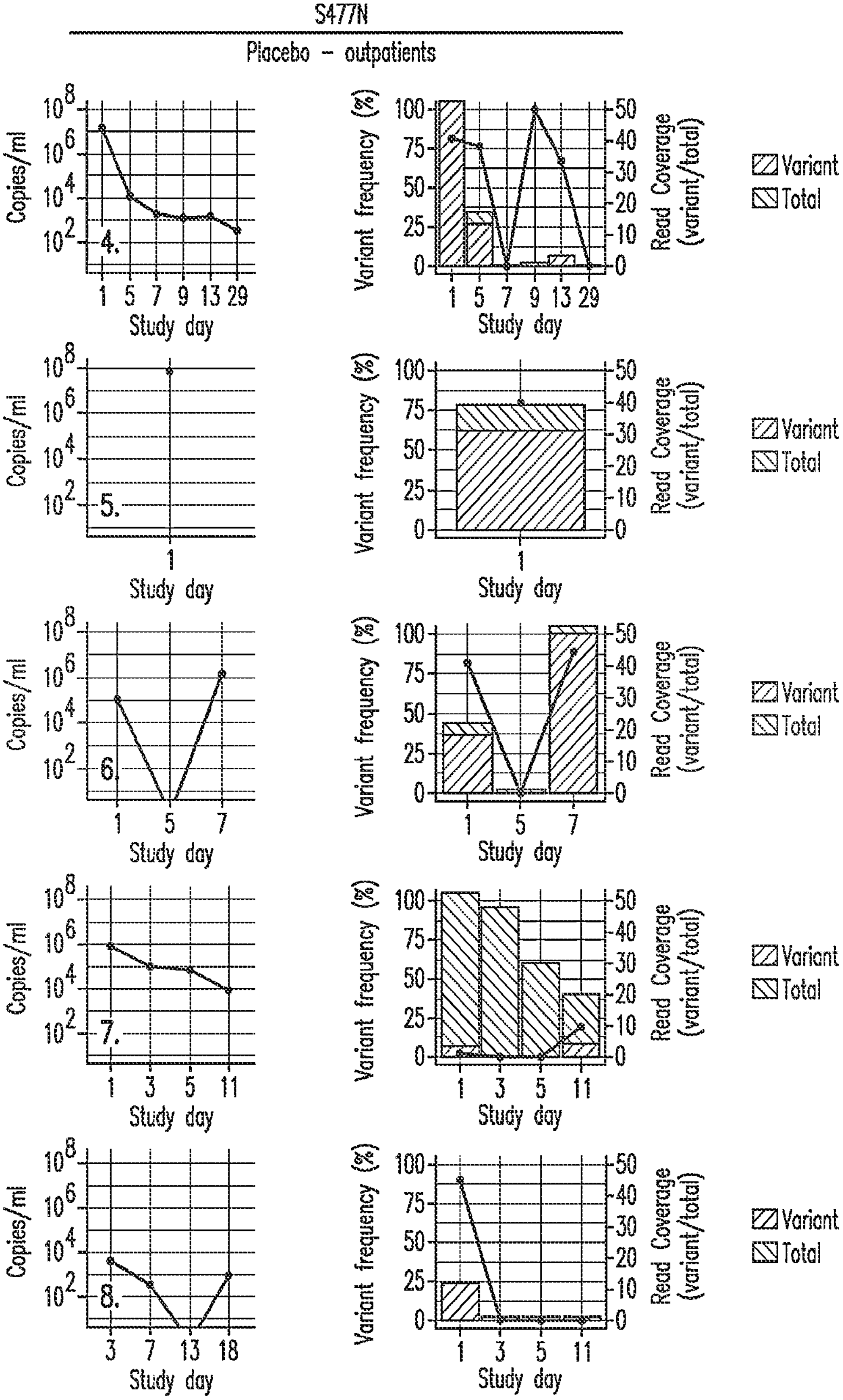

A total of 216, 248 and 212 amino acid changes were identified among the 1,215 placebo, 1,203 low-dose and 1,128 high-dose REGEN-COV treated patient samples respectively from the non-hospitalized group, spread across the entire spike protein sequence (FIGS. 28A and 28B). The RBD contained respectively, 23, 27 and 31 amino acid changes among which S477N and only 2 other variants (S494P and G446V) were identified at more than one time point in at least one REGEN-COV treated patient (FIG. 28B). The S477N variant was present in 3 REGEN-COV and 5 placebo treated patients at multiple time points, including baseline (FIGS. 32A and 32B). S494P is a rare circulating mutation (~0.15% GIDAID) only found at multiple time points (including baseline) in 2 REGEN-COV treated patients. G446V is a rare variant (~0.02% GISAID) identified in 4 REGEN-COV treated and 2 placebo patients (FIGS. 29A, and FIGS. 29B-1 and 29B-2). One of these patients (FIG. 29B-1—Patient B4), represented the only example with a consistent late increase in the relative frequency of the variant; while this could represent treatment selection in this patient, it should be pointed out that there is no evidence that the absolute frequency of the variant increased over time as viral levels dropped dramatically over time. For all G446V patients, including Patient B4, the frequency of variants was decreased to undetectable at the latest time points, indicating that drug mediated selection is unlikely.

Figure 33A:
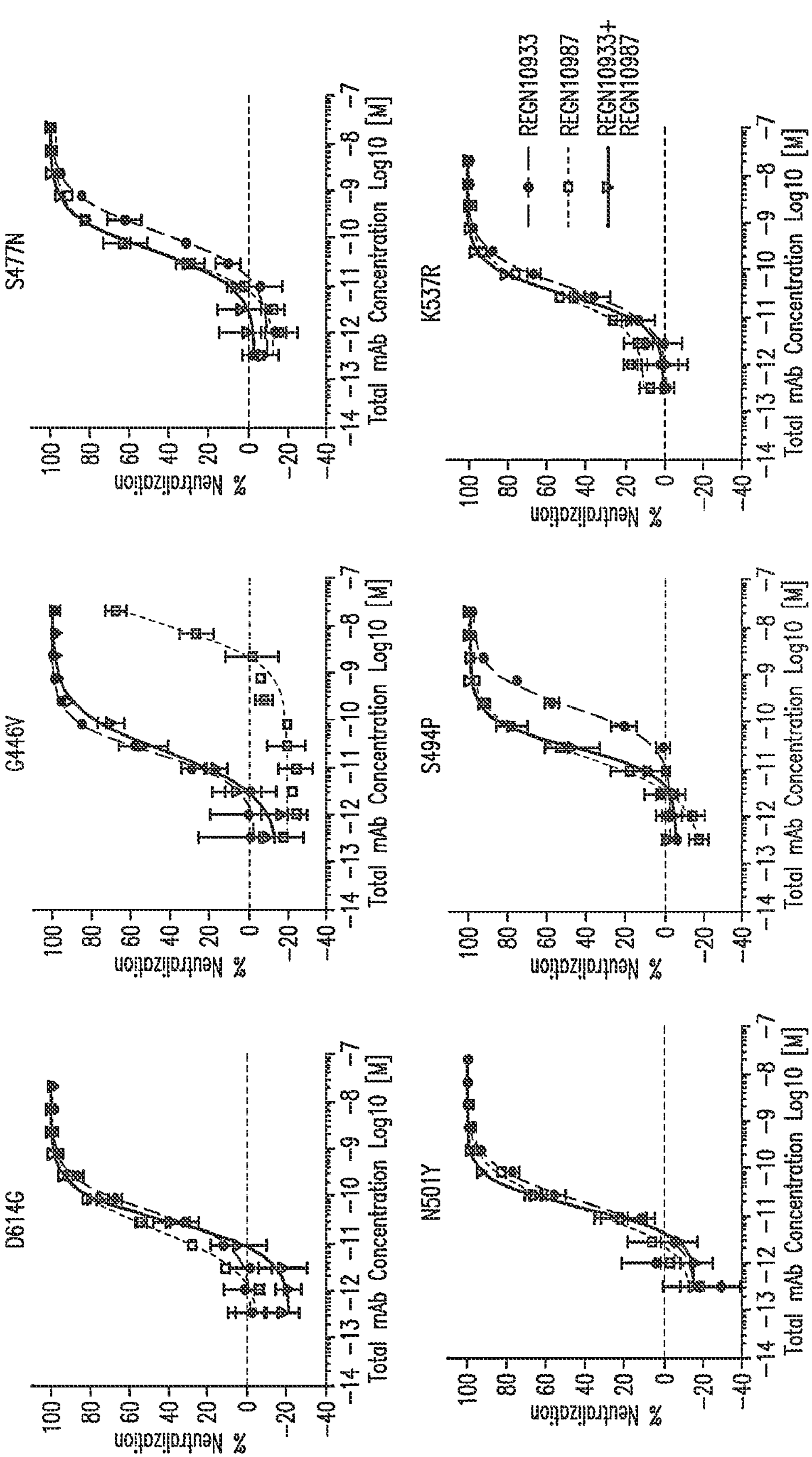

To determine the functional impact of RBD variants identified at multiple time points in REGEN-COV treated patients, individual antibodies and the combination were assessed for neutralization potency against the G446V, S494P, S477N, and K537R variants (FIGS. 33A and 33B). Decrease in neutralization potency was observed with mAb10987 (135-fold) against the G446V variant, and minimally with mAb10933 (4.5-fold) against the S494P variant, whereas no impact was observed on either mAb with the S477N or K537R variants. The N501T variant was not assessed but an alternative substitution N501Y did not show any impact on either antibody or the REGEN-COV combination. Importantly, in all instances the REGEN-COV combination retained full neutralization potency, thereby providing its full antiviral activity in treated individuals and limiting any potential selection of resistant variants.

All references cited herein are incorporated by reference to the same extent as if each individual publication, database entry (e.g., Genbank sequences or GeneID entries), patent application, or patent, was specifically and individually indicated to be incorporated by reference. This statement of incorporation by reference is intended by Applicants to relate to each and every individual publication, database entry (e.g., Genbank sequences or GeneID entries), patent application, or patent identified even if such citation is not immediately adjacent to a dedicated statement of incorporation by reference. The inclusion of dedicated statements of incorporation by reference, if any, within the specification does not in any way weaken this general statement of incorporation by reference. Citation of the references herein is not intended as an admission that the reference is pertinent prior art, nor does it constitute any admission as to the contents or date of these publications or documents.

TABLE 38

Sequences Excluded from ST.26-Formatted Sequence Listing

| SEQ ID NO: | Sequence |
|---|---|
| 13 | gacaataat |
| 14 | DNN |
| 33 | aaggcgtct |
| 34 | KAS |
| 54 | gctgcatcc |
| 55 | AAS |
| 110 | tgggcatct |
| 111 | WAS |
| 148 | ggtgtatcc |
| 149 | GVS |
| 193 | gatgcatcc |
| 194 | DAS |
| 293 | ggtgcatcc |
| 294 | GAS |
| 443 | gctgcctcc |
| 460 | aaggcatct |
| 583 | ggtaacagc |
| 584 | GNS |
| 631 | ggtaacacc |
| 632 | GNT |
| 649 | gatgtcagt |
| 650 | DVS |
| 669 | agtaataat |
| 670 | SNN |
| 819 | actgcatcc |
| 820 | TAS |

SEQUENCE LISTING (851 sequences)

SEQ ID NO: 1 - DNA, 360 bp, Artificial Sequence
  Synthetic
gaggtgcagctggtggagtctgggggaggcttggtacagcctggagggtccctgagactctcctgtgcagcctctggattcaccttcaggaattatgaaatgaactgggtccgccaggctccagggaaggggctggagtgggtttcatacattactagtagtggtagtaccatgtactacgcagactctgtgaagggccgattcaccatctccagagacaacgccaagaactcactgtatctgcaaatgaacagcctgagagccgaggacacggctgtttattactgtgcgagagacggcttttactactactacgctatggacgtctggggccaagggaccacggtcaccgtctcctca

SEQ ID NO: 2 - protein, 120 aa, Artificial Sequence
  Synthetic
EVQLVESGGGLVQPGGSLRLSCAASGFTFRNYEMNWVRQAPGKGLEWVSYITSSGSTMYYADSVKGRFTISRDNAKNSLYLQMNSLRAEDTAVYYCARDGFYYYYAMDVWGQGTTVTVSS

SEQ ID NO: 3 - DNA, 24 bp, Artificial Sequence
  Synthetic
ggattcaccttcaggaattatgaa

SEQ ID NO: 4 - protein, 8 aa, Artificial Sequence
  Synthetic
GFTFRNYE

SEQ ID NO: 5 - DNA, 24 bp, Artificial Sequence
  Synthetic
attactagtagtggtagtaccatg

SEQ ID NO: 6 - protein, 8 aa, Artificial Sequence
  Synthetic
ITSSGSTM

SEQ ID NO: 7 - DNA, 39 bp, Artificial Sequence
  Synthetic
gcgagagacggcttttactactactacgctatggacgtc

SEQ ID NO: 8 - protein, 13 aa, Artificial Sequence
  Synthetic
ARDGFYYYYAMDV

SEQ ID NO: 9 - DNA, 333 bp, Artificial Sequence
  Synthetic
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgttggccgagtcttcggaactgggaccaaggtcaccgtccta

SEQ ID NO: 10 - protein, 111 aa, Artificial Sequence
  Synthetic
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSVGRVFGTGTKVTVL

SEQ ID NO: 11 - DNA, 24 bp, Artificial Sequence
  Synthetic
agctccaacattgggaataattat

SEQ ID NO: 12 - protein, 8 aa, Artificial Sequence
  Synthetic
SSNIGNNY

SEQ ID NO: 13 - DNA, 9 bp, Artificial Sequence
  Synthetic
gacaataat

SEQ ID NO: 14 - protein, 3 aa, Artificial Sequence
  Synthetic
DNN

SEQ ID NO: 15 - DNA, 36 bp, Artificial Sequence
  Synthetic
ggaacatgggatagcagcctgagtgttggccgagtc

SEQ ID NO: 16 - protein, 12 aa, Artificial Sequence
  Synthetic
GTWDSSLSVGRV

SEQ ID NO: 17 - DNA, 1353 bp, Artificial Sequence
  Synthetic
gaggtgcagctggtggagtctgggggaggcttggtacagcctggagggtccctgagactctcctgtgcagcctctggattcaccttcaggaattatgaaatgaactgggtccgccaggctccagggaaggggctggagtgggtttcatacattactagtagtggtagtaccatgtactacgcagactctgtgaagggccgattcaccatctccagagacaacgccaagaactcactgtatctgcaaatgaacagcctgagagccgaggacacggctgtttattactgtgcgagagacggcttttactactactacgctatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 18 - protein, 450 aa, Artificial Sequence
  Synthetic
EVQLVESGGGLVQPGGSLRLSCAASGFTFRNYEMNWVRQAPGKGLEWVSYITSSGSTMYYADSVKGRFTISRDNAKNSLYLQMNSLRAEDTAVYYCARDGFYYYYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 19 - DNA, 654 bp, Artificial Sequence
  Synthetic
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgttggccgagtcttcggaactgggaccaaggtcaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 20 - protein, 217 aa, Artificial Sequence
  Synthetic
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSVGRVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 21 - DNA, 348 bp, Artificial Sequence
  Synthetic
gaggtgcagctggtggagtctggaggaggcttggtccagcctggggggtccctgagactctcctgtgcagcctctgggttcaccgtcagtagcaactacatgaactgggtccgccaggctccagggaaggggctggagtgggtctcagttatttatagcggtggcagcacattctacgcagactccgtgaagggccgattcaccatctccagacacaattccaagaacacgctgtatcttcaaatgaacagcctgagacctgaggacacggccgtgtattactgtgcgagagatctggggggatactttgactactggggccagggaaccctggtcaccgtctcctca

SEQ ID NO: 22 - protein, 116 aa, Artificial Sequence
  Synthetic
EVQLVESGGGLVQPGGSLRLSCAASGFTVSSNYMNWVRQAPGKGLEWVSVIYSGGSTFYADSVKGRFTISRHNSKNTLYLQMNSLRPEDTAVYYCARDLGGYFDYWGQGTLVTVSS

SEQ ID NO: 23 - DNA, 24 bp, Artificial Sequence
  Synthetic
gggttcaccgtcagtagcaactac

SEQ ID NO: 24 - protein, 8 aa, Artificial Sequence
  Synthetic
GFTVSSNY

SEQ ID NO: 25 - DNA, 21 bp, Artificial Sequence
  Synthetic
atttatagcggtggcagcaca

SEQ ID NO: 26 - protein, 7 aa, Artificial Sequence
  Synthetic
IYSGGST

SEQ ID NO: 27 - DNA, 30 bp, Artificial Sequence
  Synthetic
gcgagagatctggggggatactttgactac

SEQ ID NO: 28 - protein, 10 aa, Artificial Sequence
  Synthetic
ARDLGGYFDY

SEQ ID NO: 29 - DNA, 318 bp, Artificial Sequence
  Synthetic
gacatccagatgacccagtctccttccaccctgtctgcatctgtaggagacagagtcaccatcacttgccgggccagtcagagttttagtagctggttggcctggtatcagcagaaaccagggaaagcccctaagctcctgatctataaggcgtctagtttagagagtggggtcccatcaaggttcagcggcagtggatctgggacagaattcactctcaccatcagcagcctgcagcctgatgattttgcaacttattactgccaacagtataatagttattacacttttggccaggggaccaagctggagatcaaa

SEQ ID NO: 30 - protein, 106 aa, Artificial Sequence
  Synthetic
DIQMTQSPSTLSASVGDRVTITCRASQSFSSWLAWYQQKPGKAPKLLIYKASSLESGVPSRFSGSGSGTEFTLTISSLQPDDFATYYCQQYNSYYTFGQGTKLEIK

SEQ ID NO: 31 - DNA, 18 bp, Artificial Sequence
  Synthetic
cagagttttagtagctgg

SEQ ID NO: 32 - protein, 6 aa, Artificial Sequence
  Synthetic
QSFSSW

SEQ ID NO: 33 - DNA, 9 bp, Artificial Sequence
  Synthetic
aaggcgtct

SEQ ID NO: 34 - protein, 3 aa, Artificial Sequence
  Synthetic
KAS

SEQ ID NO: 35 - DNA, 24 bp, Artificial Sequence
  Synthetic
caacagtataatagttattacact

SEQ ID NO: 36 - protein, 8 aa, Artificial Sequence
  Synthetic
QQYNSYYT

SEQ ID NO: 37 - DNA, 1341 bp, Artificial Sequence
  Synthetic
gaggtgcagctggtggagtctggaggaggcttggtccagcctggggggtccctgagactctcctgtgcagcctctgggttcaccgtcagtagcaactacatgaactgggtccgccaggctccagggaaggggctggagtgggtctcagttatttatagcggtggcagcacattctacgcagactccgtgaagggccgattcaccatctccagacacaattccaagaacacgctgtatcttcaaatgaacagcctgagacctgaggacacggccgtgtattactgtgcgagagatctggggggatactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 38 - protein, 446 aa, Artificial Sequence
  Synthetic
EVQLVESGGGLVQPGGSLRLSCAASGFTVSSNYMNWVRQAPGKGLEWVSVIYSGGSTFYADSVKGRFTISRHNSKNTLYLQMNSLRPEDTAVYYCARDLGGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 39 - DNA, 642 bp, Artificial Sequence
  Synthetic
gacatccagatgacccagtctccttccaccctgtctgcatctgtaggagacagagtcaccatcacttgccgggccagtcagagttttagtagctggttggcctggtatcagcagaaaccagggaaagcccctaagctcctgatctataaggcgtctagtttagagagtggggtcccatcaaggttcagcggcagtggatctgggacagaattcactctcaccatcagcagcctgcagcctgatgattttgcaacttattactgccaacagtataatagttattacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 40 - protein, 213 aa, Artificial Sequence
  Synthetic
DIQMTQSPSTLSASVGDRVTITCRASQSFSSWLAWYQQKPGKAPKLLIYKASSLESGVPSRFSGSGSGTEFTLTISSLQPDDFATYYCQQYNSYYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41 - DNA, 1341 bp, Artificial Sequence
  Synthetic
gaggtgcagctggtggagtctgggggaggcttggtacagcctggagggtccctgagactctcctgtgcagcctctggattcaccttcaggaattatgaaatgaactgggtccgccaggctccagggaaggggctggagtgggtttcatacattactagtagtggtagtaccatgtactacgcagactctgtgaagggccgattcaccatctccagagacaacgccaagaactcactgtatctgcaaatgaacagcctgagagccgaggacacggctgtttattactgtgcgagagacggcttttactactactacgctatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 42 - protein, 446 aa, Artificial Sequence
  Synthetic
EVQLVESGGGLVQPGGSLRLSCAASGFTFRNYEMNWVRQAPGKGLEWVSYITSSGSTMYYADSVKGRFTISRDNAKNSLYLQMNSLRAEDTAVYYCARDGFYYYYAMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 43 - DNA, 351 bp, Artificial Sequence
  Synthetic
gaggtgcagctggtggagtctggaggaggcttggtccagcctggggggtccctgagactctcctgtgcagcctctgggttaatagtcagtcgcaactacatgatctgggtccgccaggctccagggaaggggctggagtgggtctcagttatttatagcggtggtagcacattctacgcagactccgtgaagggccgattcaccatctccagacacaattccaagaacacgctgtatcttcaaatgaacagcctgagagctgaggacacggccgtatattactgtgcgagagatctgggtacaggaggtatggacgtctggggccaagggaccacggtcaccgtctcctca

SEQ ID NO: 44 - protein, 117 aa, Artificial Sequence
  Synthetic
EVQLVESGGGLVQPGGSLRLSCAASGLIVSRNYMIWVRQAPGKGLEWVSVIYSGGSTFYADSVKGRFTISRHNSKNTLYLQMNSLRAEDTAVYYCARDLGTGGMDVWGQGTTVTVSS

SEQ ID NO: 45 - DNA, 24 bp, Artificial Sequence
  Synthetic
gggttaatagtcagtcgcaactac

SEQ ID NO: 46 - protein, 8 aa, Artificial Sequence
  Synthetic
GLIVSRNY

SEQ ID NO: 47 - DNA, 21 bp, Artificial Sequence
  Synthetic
atttatagcggtggtagcaca

SEQ ID NO: 48 - DNA, 33 bp, Artificial Sequence
  Synthetic
gcgagagatctgggtacaggaggtatggacgtc

SEQ ID NO: 49 - protein, 11 aa, Artificial Sequence
  Synthetic
ARDLGTGGMDV

SEQ ID NO: 50 - DNA, 321 bp, Artificial Sequence
  Synthetic
gacatccagttgacccagtctccatccttcctgtctgcatctgtaggagacagagtcaccatcacttgctgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctctcactttcggcggagggaccaaggtggagatcaaa

SEQ ID NO: 51 - protein, 107 aa, Artificial Sequence
  Synthetic
DIQLTQSPSFLSASVGDRVTITCWASQGISSYLAWYQQKPGKAPKLLIYAASTLQSGVPSRFSGSGSGTEFTLTISSLQPEDFATYYCQQLNSYPLTFGGGTKVEIK

SEQ ID NO: 52 - DNA, 18 bp, Artificial Sequence
  Synthetic
cagggcattagcagttat

SEQ ID NO: 53 - protein, 6 aa, Artificial Sequence
  Synthetic
QGISSY

SEQ ID NO: 54 - DNA, 9 bp, Artificial Sequence
  Synthetic
gctgcatcc

SEQ ID NO: 55 - protein, 3 aa, Artificial Sequence
  Synthetic
AAS

SEQ ID NO: 56 - DNA, 27 bp, Artificial Sequence
  Synthetic
caacagcttaatagttaccctctcact

SEQ ID NO: 57 - protein, 9 aa, Artificial Sequence
  Synthetic
QQLNSYPLT

SEQ ID NO: 58 - DNA, 1332 bp, Artificial Sequence
  Synthetic
gaggtgcagctggtggagtctggaggaggcttggtccagcctggggggtccctgagactctcctgtgcagcctctgggttaatagtcagtcgcaactacatgatctgggtccgccaggctccagggaaggggctggagtgggtctcagttatttatagcggtggtagcacattctacgcagactccgtgaagggccgattcaccatctccagacacaattccaagaacacgctgtatcttcaaatgaacagcctgagagctgaggacacggccgtatattactgtgcgagagatctgggtacaggaggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 59 - protein, 443 aa, Artificial Sequence
  Synthetic
EVQLVESGGGLVQPGGSLRLSCAASGLIVSRNYMIWVRQAPGKGLEWVSVIYSGGSTFYADSVKGRFTISRHNSKNTLYLQMNSLRAEDTAVYYCARDLGTGGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 60 - DNA, 645 bp, Artificial Sequence
  Synthetic
gacatccagttgacccagtctccatccttcctgtctgcatctgtaggagacagagtcaccatcacttgctgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 61 - protein, 214 aa, Artificial Sequence
  Synthetic
DIQLTQSPSFLSASVGDRVTITCWASQGISSYLAWYQQKPGKAPKLLIYAASTLQSGVPSRFSGSGSGTEFTLTISSLQPEDFATYYCQQLNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 62 - DNA, 1329 bp, Artificial Sequence
  Synthetic
gaggtgcagctggtggagtctggaggaggcttggtccagcctggggggtccctgagactctcctgtgcagcctctgggttcaccgtcagtagcaactacatgaactgggtccgccaggctccagggaaggggctggagtgggtctcagttatttatagcggtggcagcacattctacgcagactccgtgaagggccgattcaccatctccagacacaattccaagaacacgctgtatcttcaaatgaacagcctgagacctgaggacacggccgtgtattactgtgcgagagatctggggggatactttgactactggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 63 - protein, 442 aa, Artificial Sequence
  Synthetic
EVQLVESGGGLVQPGGSLRLSCAASGFTVSSNYMNWVRQAPGKGLEWVSVIYSGGSTFYADSVKGRFTISRHNSKNTLYLQMNSLRPEDTAVYYCARDLGGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 64 - DNA, 360 bp, Artificial Sequence
  Synthetic
caggtgcagctggtggagtctgggggaggcgtggtccagcctgggaggtccctgagactctcctgtgcagcgtctggattcaccttcagttactatggcatgcactgggtccgccaggctccaggcaaggggctggagtgggtggcagttatatggtatgatggaagtaataaattctatgcagactccgtgaagggccgattcaccatctccagagacaattccaagaacacgctgtatctgcaaatgaacagcctgagagccgaggacacggctgtgtattactgtgcggcagctcggccgggctactactacggtatggacgtctggggccaagggaccacggtcaccgtctcctca

SEQ ID NO: 65 - protein, 120 aa, Artificial Sequence
  Synthetic
QVQLVESGGGVVQPGRSLRLSCAASGFTFSYYGMHWVRQAPGKGLEWVAVIWYDGSNKFYADSVKGRFTISRDNSKNTLYLQMNSLRAEDTAVYYCAAARPGYYYGMDVWGQGTTVTVSS

SEQ ID NO: 66 - DNA, 24 bp, Artificial Sequence
  Synthetic
ggattcaccttcagttactatggc

SEQ ID NO: 67 - protein, 8 aa, Artificial Sequence
  Synthetic
GFTFSYYG

SEQ ID NO: 68 - DNA, 24 bp, Artificial Sequence
  Synthetic
atatggtatgatggaagtaataaa

SEQ ID NO: 69 - protein, 8 aa, Artificial Sequence
  Synthetic
IWYDGSNK

SEQ ID NO: 70 - DNA, 39 bp, Artificial Sequence
  Synthetic
gcggcagctcggccgggctactactacggtatggacgtc

SEQ ID NO: 71 - protein, 13 aa, Artificial Sequence
  Synthetic
AAARPGYYYGMDV

SEQ ID NO: 72 - DNA, 321 bp, Artificial Sequence
  Synthetic
gacatccagatgacccagtctccatcctcactgtctgcttctgtaggagacagagtcaccatcacttgtcgggcgagtcagggcattagcaattatttagcctggtttcagcagaaaccagggaaagcccctaattccctgatctatgctgcatccagtttgcaacgtggggtcccatcaaagttcagcggcagtggatctgggacagatttcactctcaccatcagcagcctgcagcctgaagattttgcaacttattactgccaacagtataatagttaccctcggacgttcggccaagggaccaaggtggaaatcaaa

SEQ ID NO: 73 - protein, 107 aa, Artificial Sequence
  Synthetic
DIQMTQSPSSLSASVGDRVTITCRASQGISNYLAWFQQKPGKAPNSLIYAASSLQRGVPSKFSGSGSGTDFTLTISSLQPEDFATYYCQQYNSYPRTFGQGTKVEIK

SEQ ID NO: 74 - DNA, 18 bp, Artificial Sequence
  Synthetic
cagggcattagcaattat

SEQ ID NO: 75 - protein, 6 aa, Artificial Sequence
  Synthetic
QGISNY

SEQ ID NO: 76 - DNA, 27 bp, Artificial Sequence
  Synthetic
caacagtataatagttaccctcggacg

SEQ ID NO: 77 - protein, 9 aa, Artificial Sequence
  Synthetic
QQYNSYPRT

SEQ ID NO: 78 - DNA, 1353 bp, Artificial Sequence
  Synthetic
caggtgcagctggtggagtctgggggaggcgtggtccagcctgggaggtccctgagactctcctgtgcagcgtctggattcaccttcagttactatggcatgcactgggtccgccaggctccaggcaaggggctggagtgggtggcagttatatggtatgatggaagtaataaattctatgcagactccgtgaagggccgattcaccatctccagagacaattccaagaacacgctgtatctgcaaatgaacagcctgagagccgaggacacggctgtgtattactgtgcggcagctcggccgggctactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 79 - protein, 450 aa, Artificial Sequence
  Synthetic
QVQLVESGGGVVQPGRSLRLSCAASGFTFSYYGMHWVRQAPGKGLEWVAVIWYDGSNKFYADSVKGRFTISRDNSKNTLYLQMNSLRAEDTAVYYCAAARPGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - DNA, 645 bp, Artificial Sequence
  Synthetic
gacatccagatgacccagtctccatcctcactgtctgcttctgtaggagacagagtcaccatcacttgtcgggcgagtcagggcattagcaattatttagcctggtttcagcagaaaccagggaaagcccctaattccctgatctatgctgcatccagtttgcaacgtggggtcccatcaaagttcagcggcagtggatctgggacagatttcactctcaccatcagcagcctgcagcctgaagattttgcaacttattactgccaacagtataatagttaccctcggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 81 - protein, 214 aa, Artificial Sequence
  Synthetic
DIQMTQSPSSLSASVGDRVTITCRASQGISNYLAWFQQKPGKAPNSLIYAASSLQRGVPSKFSGSGSGTDFTLTISSLQPEDFATYYCQQYNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 82 - DNA, 351 bp, Artificial Sequence
  Synthetic
gaggtgcagctggtggagtctggaggaggcttggtccagcctggggggtccctgagactctcctgtgcagcctctgggatcaccgtcagtagcaactacatgagctgggtccgccaggctccagggaaggggctggagtgggtctcagttatttatagcggtggtagcacattctacgcagactccgtgaagggccgattcaccatctccagacacaattccaagaacacgctgtatcttcaaatgaacagcctgagagctgaggacacggccgtgtattactgtgcgagagaacgtaactttgatgcttttgatatctggggccaagggacaatggtcaccgtctcttca

SEQ ID NO: 83 - protein, 117 aa, Artificial Sequence
  Synthetic
EVQLVESGGGLVQPGGSLRLSCAASGITVSSNYMSWVRQAPGKGLEWVSVIYSGGSTFYADSVKGRFTISRHNSKNTLYLQMNSLRAEDTAVYYCARERNFDAFDIWGQGTMVTVSS

SEQ ID NO: 84 - DNA, 24 bp, Artificial Sequence
  Synthetic
gggatcaccgtcagtagcaactac

SEQ ID NO: 85 - protein, 8 aa, Artificial Sequence
  Synthetic
GITVSSNY

SEQ ID NO: 86 - DNA, 33 bp, Artificial Sequence
  Synthetic
gcgagagaacgtaactttgatgcttttgatatc

SEQ ID NO: 87 - protein, 11 aa, Artificial Sequence
  Synthetic
ARERNFDAFDI

SEQ ID NO: 88 - DNA, 324 bp, Artificial Sequence
  Synthetic
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccccctattcactttcggccctgggaccaaagtggatatcaaa

SEQ ID NO: 89 - protein, 108 aa, Artificial Sequence
  Synthetic
DIQMTQSPSSVSASVGDRVTITCRASQGISSWLAWYQQKPGKAPKLLIYAASSLQSGVPSRFSGSGSGTDFTLTISSLQPEDFATYYCQQANSFPLFTFGPGTKVDIK

SEQ ID NO: 90 - DNA, 18 bp, Artificial Sequence
  Synthetic
cagggtattagcagctgg

SEQ ID NO: 91 - protein, 6 aa, Artificial Sequence
  Synthetic
QGISSW

SEQ ID NO: 92 - DNA, 30 bp, Artificial Sequence
  Synthetic
caacaggctaacagtttccccctattcact

SEQ ID NO: 93 - protein, 10 aa, Artificial Sequence
  Synthetic
QQANSFPLFT

SEQ ID NO: 94 - DNA, 1344 bp, Artificial Sequence
  Synthetic
gaggtgcagctggtggagtctggaggaggcttggtccagcctggggggtccctgagactctcctgtgcagcctctgggatcaccgtcagtagcaactacatgagctgggtccgccaggctccagggaaggggctggagtgggtctcagttatttatagcggtggtagcacattctacgcagactccgtgaagggccgattcaccatctccagacacaattccaagaacacgctgtatcttcaaatgaacagcctgagagctgaggacacggccgtgtattactgtgcgagagaacgtaactttgatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 95 - protein, 447 aa, Artificial Sequence
  Synthetic
EVQLVESGGGLVQPGGSLRLSCAASGITVSSNYMSWVRQAPGKGLEWVSVIYSGGSTFYADSVKGRFTISRHNSKNTLYLQMNSLRAEDTAVYYCARERNFDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - DNA, 648 bp, Artificial Sequence
  Synthetic
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccccctattcactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 97 - protein, 215 aa, Artificial Sequence
  Synthetic
DIQMTQSPSSVSASVGDRVTITCRASQGISSWLAWYQQKPGKAPKLLIYAASSLQSGVPSRFSGSGSGTDFTLTISSLQPEDFATYYCQQANSFPLFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 98 - DNA, 357 bp, Artificial Sequence
  Synthetic
gaggtgcagctggtggagtctgggggaggcttggtacagcctggagggtccctgagactctcctgtgcagcctctggattcaccttcagtatttatgaaatgaactgggtccgccaggctccagggaaggggctggagtgggtttcatacattactagtagtggtactaccatatactacgcagactctgtgaagggccgattcaccatctccagagacaacgccaagaactcactgtatctgcaaatgaacagcctgagagccgaggacacggctgtttattactgtgcgagtagcagctcgtccgggtactactttgactactggggccagggaaccctggtcaccgtctcctca

SEQ ID NO: 99 - protein, 119 aa, Artificial Sequence
  Synthetic
EVQLVESGGGLVQPGGSLRLSCAASGFTFSIYEMNWVRQAPGKGLEWVSYITSSGTTIYYADSVKGRFTISRDNAKNSLYLQMNSLRAEDTAVYYCASSSSSGYYFDYWGQGTLVTVSS

SEQ ID NO: 100 - DNA, 24 bp, Artificial Sequence
  Synthetic
ggattcaccttcagtatttatgaa

SEQ ID NO: 101 - protein, 8 aa, Artificial Sequence
  Synthetic
GFTFSIYE

SEQ ID NO: 102 - DNA, 24 bp, Artificial Sequence
  Synthetic
attactagtagtggtactaccata

SEQ ID NO: 103 - protein, 8 aa, Artificial Sequence
  Synthetic
ITSSGTTI

SEQ ID NO: 104 - DNA, 36 bp, Artificial Sequence
  Synthetic
gcgagtagcagctcgtccgggtactactttgactac

SEQ ID NO: 105 - protein, 12 aa, Artificial Sequence
  Synthetic
ASSSSSGYYFDY

SEQ ID NO: 106 - DNA, 339 bp, Artificial Sequence
  Synthetic
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaatctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcccacttttggccaggggaccaagctggagatcaaa

SEQ ID NO: 107 - protein, 113 aa, Artificial Sequence
  Synthetic
DIVMTQSPDSLAVSLGERATINCKSSQSVLYSSNNKNYLAWYQQKPGQPPNLLIYWASTRESGVPDRFSGSGSGTDFTLTISSLQAEDVAVYYCQQYYSTPPTFGQGTKLEIK

SEQ ID NO: 108 - DNA, 36 bp, Artificial Sequence
  Synthetic
cagagtgttttatacagctccaacaataagaactac

SEQ ID NO: 109 - protein, 12 aa, Artificial Sequence
  Synthetic
QSVLYSSNNKNY

SEQ ID NO: 110 - DNA, 9 bp, Artificial Sequence
  Synthetic
tgggcatct

SEQ ID NO: 111 - protein, 3 aa, Artificial Sequence
  Synthetic
WAS

SEQ ID NO: 112 - DNA, 27 bp, Artificial Sequence
  Synthetic
cagcaatattatagtactcctcccact

SEQ ID NO: 113 - protein, 9 aa, Artificial Sequence
  Synthetic
QQYYSTPPT

SEQ ID NO: 114 - DNA, 1350 bp, Artificial Sequence
  Synthetic
gaggtgcagctggtggagtctgggggaggcttggtacagcctggagggtccctgagactctcctgtgcagcctctggattcaccttcagtatttatgaaatgaactgggtccgccaggctccagggaaggggctggagtgggtttcatacattactagtagtggtactaccatatactacgcagactctgtgaagggccgattcaccatctccagagacaacgccaagaactcactgtatctgcaaatgaacagcctgagagccgaggacacggctgtttattactgtgcgagtagcagctcgtccgggtactactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 115 - protein, 449 aa, Artificial Sequence
  Synthetic
EVQLVESGGGLVQPGGSLRLSCAASGFTFSIYEMNWVRQAPGKGLEWVSYITSSGTTIYYADSVKGRFTISRDNAKNSLYLQMNSLRAEDTAVYYCASSSSSGYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 116 - DNA, 663 bp, Artificial Sequence
  Synthetic
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaatctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcccacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 117 - protein, 220 aa, Artificial Sequence
  Synthetic
DIVMTQSPDSLAVSLGERATINCKSSQSVLYSSNNKNYLAWYQQKPGQPPNLLIYWASTRESGVPDRFSGSGSGTDFTLTISSLQAEDVAVYYCQQYYSTPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 118 - DNA, 363 bp, Artificial Sequence
  Synthetic
caggtgcagctggtgcagtctggggctgaggtgaagaagcctggggcctcagtgaaggtctcctgcaaggcttctggatacaccttcattaactactatatacactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgattattacgatttttggagtggttacctggttcgacccctggggccagggaaccctggtcaccgtctcctca

SEQ ID NO: 119 - protein, 121 aa, Artificial Sequence
  Synthetic
QVQLVQSGAEVKKPGASVKVSCKASGYTFINYYIHWVRQAPGQGLEWMGWINPNSGGTNYAQKFQGRVTMTRDTSISTAYMELSRLRSDDTAVYYCAIITIFGVVTWFDPWGQGTLVTVSS

SEQ ID NO: 120 - DNA, 24 bp, Artificial Sequence
  Synthetic
ggatacaccttcattaactactat

SEQ ID NO: 121 - protein, 8 aa, Artificial Sequence
  Synthetic
GYTFINYY

SEQ ID NO: 122 - DNA, 24 bp, Artificial Sequence
  Synthetic
atcaaccctaacagtggtggcaca

SEQ ID NO: 123 - protein, 8 aa, Artificial Sequence
  Synthetic
INPNSGGT

SEQ ID NO: 124 - DNA, 42 bp, Artificial Sequence
  Synthetic
gcgattattacgatttttggagtggttacctggttcgacccc

SEQ ID NO: 125 - protein, 14 aa, Artificial Sequence
  Synthetic
AIITIFGVVTWFDP

SEQ ID NO: 126 - DNA, 321 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgctcactttcggcggagggaccaaggtggagatcaaa

SEQ ID NO: 127 - protein, 107 aa, Artificial Sequence [sequence omitted]

SEQ ID NO: 128 - DNA, 18 bp, Artificial Sequence
  Synthetic
cagagcattagcagctat

SEQ ID NO: 129 - protein, 6 aa, Artificial Sequence
  Synthetic
QSISSY

SEQ ID NO: 130 - DNA, 27 bp, Artificial Sequence
  Synthetic
caacagagttacagtaccccgctcact

SEQ ID NO: 131 - protein, 9 aa, Artificial Sequence
  Synthetic
QQSYSTPLT

SEQ ID NO: 132 - DNA, 1356 bp, Artificial Sequence
  Synthetic
caggtgcagctggtgcagtctggggctgaggtgaagaagcctggggcctcagtgaaggtctcctgcaaggcttctggatacaccttcattaactactatatacactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgattattacgatttttggagtggttacctggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 133 - protein, 451 aa, Artificial Sequence
  Synthetic
QVQLVQSGAEVKKPGASVKVSCKASGYTFINYYIHWVRQAPGQGLEWMGWINPNSGGTNYAQKFQGRVTMTRDTSISTAYMELSRLRSDDTAVYYCAIITIFGVVTWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 134 - DNA, 645 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 135 - protein, 214 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 136 - DNA, 345 bp, Artificial Sequence
  Synthetic
caggtgcagctgcaggagtcgggcccaggactggtgaagccttcggagaccctgtccctcacctgcactgtctctggtggctccatcagtagttactactggagttggatccggcagcccccagggaagggactggagtggattgggtatatctattacagtgggagcaccaactacaacccctccctcaagagtcgagtcaccatatcagtagacacgtccaagaaccagttctccctgaaactgagctctgtgaccgctgcggacacggccgtgtattactgtgcgagagacccgctcctcattgactactggggccagggaaccctggtcaccgtctcctca

SEQ ID NO: 137 - protein, 115 aa, Artificial Sequence
  Synthetic
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARDPLLIDYWGQGTLVTVSS

SEQ ID NO: 138 - DNA, 24 bp, Artificial Sequence
  Synthetic
ggtggctccatcagtagttactac

SEQ ID NO: 139 - protein, 8 aa, Artificial Sequence
  Synthetic
GGSISSYY

SEQ ID NO: 140 - DNA, 21 bp, Artificial Sequence
  Synthetic
atctattacagtgggagcacc

SEQ ID NO: 141 - protein, 7 aa, Artificial Sequence
  Synthetic
IYYSGST

SEQ ID NO: 142 - DNA, 27 bp, Artificial Sequence
  Synthetic
gcgagagacccgctcctcattgactac

SEQ ID NO: 143 - protein, 9 aa, Artificial Sequence
  Synthetic
ARDPLLIDY

SEQ ID NO: 144 - DNA, 324 bp, Artificial Sequence
  Synthetic
gaaattgtgttgacgcagtctccaggtaccctgtctttgtctccaggggaaagagccaccctctcctgcagggccagtcagagtgttagtagaagctacttagcctggtaccagcagaaacctggccaggctcccaggctcctcatctatggtgtatccagcagggccactggcatcccagacaggttcagcggcagtgggtctgggacagacttcactctcaccatcagcagactggagcctgaagattttgcagtgtattattgtcagcagtatggtagctcacctcagacttttggccaggggaccaagctggagatcaaa

SEQ ID NO: 145 - protein, 108 aa, Artificial Sequence
  Synthetic
EIVLTQSPGTLSLSPGERATLSCRASQSVSRSYLAWYQQKPGQAPRLLIYGVSSRATGIPDRFSGSGSGTDFTLTISRLEPEDFAVYYCQQYGSSPQTFGQGTKLEIK

SEQ ID NO: 146 - DNA, 21 bp, Artificial Sequence
  Synthetic
cagagtgttagtagaagctac

SEQ ID NO: 147 - protein, 7 aa, Artificial Sequence
  Synthetic
QSVSRSY

SEQ ID NO: 148 - DNA, 9 bp, Artificial Sequence
  Synthetic
ggtgtatcc

SEQ ID NO: 149 - protein, 3 aa, Artificial Sequence
  Synthetic
GVS

SEQ ID NO: 150 - DNA, 27 bp, Artificial Sequence
  Synthetic
cagcagtatggtagctcacctcagact

SEQ ID NO: 151 - protein, 9 aa, Artificial Sequence
  Synthetic
QQYGSSPQT

SEQ ID NO: 152 - DNA, 1338 bp, Artificial Sequence
  Synthetic
caggtgcagctgcaggagtcgggcccaggactggtgaagccttcggagaccctgtccctcacctgcactgtctctggtggctccatcagtagttactactggagttggatccggcagcccccagggaagggactggagtggattgggtatatctattacagtgggagcaccaactacaacccctccctcaagagtcgagtcaccatatcagtagacacgtccaagaaccagttctccctgaaactgagctctgtgaccgctgcggacacggccgtgtattactgtgcgagagacccgctcctcattgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 153 - protein, 445 aa, Artificial Sequence
  Synthetic
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARDPLLIDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 154 - DNA, 648 bp, Artificial Sequence
  Synthetic
gaaattgtgttgacgcagtctccaggtaccctgtctttgtctccaggggaaagagccaccctctcctgcagggccagtcagagtgttagtagaagctacttagcctggtaccagcagaaacctggccaggctcccaggctcctcatctatggtgtatccagcagggccactggcatcccagacaggttcagcggcagtgggtctgggacagacttcactctcaccatcagcagactggagcctgaagattttgcagtgtattattgtcagcagtatggtagctcacctcagacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 155 - protein, 215 aa, Artificial Sequence
  Synthetic
EIVLTQSPGTLSLSPGERATLSCRASQSVSRSYLAWYQQKPGQAPRLLIYGVSSRATGIPDRFSGSGSGTDFTLTISRLEPEDFAVYYCQQYGSSPQTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 156 - DNA, 1341 bp, Artificial Sequence
  Synthetic
caggtgcagctggtggagtctgggggaggcgtggtccagcctgggaggtccctgagactctcctgtgcagcgtctggattcaccttcagttactatggcatgcactgggtccgccaggctccaggcaaggggctggagtgggtggcagttatatggtatgatggaagtaataaattctatgcagactccgtgaagggccgattcaccatctccagagacaattccaagaacacgctgtatctgcaaatgaacagcctgagagccgaggacacggctgtgtattactgtgcggcagctcggccgggctactactacggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 157 - protein, 446 aa, Artificial Sequence
  Synthetic
QVQLVESGGGVVQPGRSLRLSCAASGFTFSYYGMHWVRQAPGKGLEWVAVIWYDGSNKFYADSVKGRFTISRDNSKNTLYLQMNSLRAEDTAVYYCAAARPGYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 158 - DNA, 1332 bp, Artificial Sequence
  Synthetic
gaggtgcagctggtggagtctggaggaggcttggtccagcctggggggtccctgagactctcctgtgcagcctctgggatcaccgtcagtagcaactacatgagctgggtccgccaggctccagggaaggggctggagtgggtctcagttatttatagcggtggtagcacattctacgcagactccgtgaagggccgattcaccatctccagacacaattccaagaacacgctgtatcttcaaatgaacagcctgagagctgaggacacggccgtgtattactgtgcgagagaacgtaactttgatgcttttgatatctggggccaagggacaatggtcaccgtctcttcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 159 - protein, 443 aa, Artificial Sequence
  Synthetic
EVQLVESGGGLVQPGGSLRLSCAASGITVSSNYMSWVRQAPGKGLEWVSVIYSGGSTFYADSVKGRFTISRHNSKNTLYLQMNSLRAEDTAVYYCARERNFDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 160 - DNA, 1338 bp, Artificial Sequence
  Synthetic
gaggtgcagctggtggagtctgggggaggcttggtacagcctggagggtccctgagactctcctgtgcagcctctggattcaccttcagtatttatgaaatgaactgggtccgccaggctccagggaaggggctggagtgggtttcatacattactagtagtggtactaccatatactacgcagactctgtgaagggccgattcaccatctccagagacaacgccaagaactcactgtatctgcaaatgaacagcctgagagccgaggacacggctgtttattactgtgcgagtagcagctcgtccgggtactactttgactactggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 161 - protein, 445 aa, Artificial Sequence
  Synthetic
EVQLVESGGGLVQPGGSLRLSCAASGFTFSIYEMNWVRQAPGKGLEWVSYITSSGTTIYYADSVKGRFTISRDNAKNSLYLQMNSLRAEDTAVYYCASSSSSGYYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 162 - DNA, 1344 bp, Artificial Sequence
  Synthetic
caggtgcagctggtgcagtctggggctgaggtgaagaagcctggggcctcagtgaaggtctcctgcaaggcttctggatacaccttcattaactactatatacactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgattattacgatttttggagtggttacctggttcgacccctggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 163 - protein, 447 aa, Artificial Sequence
  Synthetic
QVQLVQSGAEVKKPGASVKVSCKASGYTFINYYIHWVRQAPGQGLEWMGWINPNSGGTNYAQKFQGRVTMTRDTSISTAYMELSRLRSDDTAVYYCAIITIFGVVTWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 164 - DNA, 1326 bp, Artificial Sequence
  Synthetic
caggtgcagctgcaggagtcgggcccaggactggtgaagccttcggagaccctgtccctcacctgcactgtctctggtggctccatcagtagttactactggagttggatccggcagcccccagggaagggactggagtggattgggtatatctattacagtgggagcaccaactacaacccctccctcaagagtcgagtcaccatatcagtagacacgtccaagaaccagttctccctgaaactgagctctgtgaccgctgcggacacggccgtgtattactgtgcgagagacccgctcctcattgactactggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 165 - protein, 441 aa, Artificial Sequence
  Synthetic
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARDPLLIDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 166 - DNA, 375 bp, Artificial Sequence
  Synthetic
gaagtgcagctggtggagtctgggggaggcttggtacagcctggcaggtccctgagactctcctgtgcagcctctggattcacctttgatgattatgccatgtactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgcggacacggccttgtattactgtgcaaaagataaagactggaactcgagaggttactactactacggtatggacgtctggggccaagggaccacggtcaccgtctcctca

SEQ ID NO: 167 - protein, 125 aa, Artificial Sequence
  Synthetic
EVQLVESGGGLVQPGRSLRLSCAASGFTFDDYAMYWVRQAPGKGLEWVSGISWNSGSIGYADSVKGRFTISRDNAKNSLYLQMNSLRAADTALYYCAKDKDWNSRGYYYYGMDVWGQGTTVTVSS

SEQ ID NO: 168 - DNA, 24 bp, Artificial Sequence
  Synthetic
ggattcacctttgatgattatgcc

SEQ ID NO: 169 - protein, 8 aa, Artificial Sequence
  Synthetic
GFTFDDYA

SEQ ID NO: 170 - DNA, 24 bp, Artificial Sequence
  Synthetic
attagttggaatagtggtagcata

SEQ ID NO: 171 - protein, 8 aa, Artificial Sequence
  Synthetic
ISWNSGSI

SEQ ID NO: 172 - DNA, 54 bp, Artificial Sequence
  Synthetic
gcaaaagataaagactggaactcgagaggttactactactacggtatggacgtc

SEQ ID NO: 173 - protein, 18 aa, Artificial Sequence
  Synthetic
AKDKDWNSRGYYYYGMDV

SEQ ID NO: 174 - DNA, 321 bp, Artificial Sequence
  Synthetic
gatgttgtgatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacattactccgtacacttttggccaggggaccaaggtggagatcaaa

SEQ ID NO: 175 - protein, 107 aa, Artificial Sequence
  Synthetic
DVVMTQSPSSLSASVGDRVTITCRASQSISSYLNWYQQKPGKAPKLLIYAASSLQSGVPSRFSGSGSGTDFTLTISSLQPEDFATYYCQQSYITPYTFGQGTKVEIK

SEQ ID NO: 176 - DNA, 27 bp, Artificial Sequence
  Synthetic
caacagagttacattactccgtacact

SEQ ID NO: 177 - protein, 9 aa, Artificial Sequence
  Synthetic
QQSYITPYT

SEQ ID NO: 178 - DNA, 1368 bp, Artificial Sequence
  Synthetic
gaagtgcagctggtggagtctgggggaggcttggtacagcctggcaggtccctgagactctcctgtgcagcctctggattcacctttgatgattatgccatgtactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgcggacacggccttgtattactgtgcaaaagataaagactggaactcgagaggttactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 179 - protein, 455 aa, Artificial Sequence
  Synthetic
EVQLVESGGGLVQPGRSLRLSCAASGFTFDDYAMYWVRQAPGKGLEWVSGISWNSGSIGYADSVKGRFTISRDNAKNSLYLQMNSLRAADTALYYCAKDKDWNSRGYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - DNA, 645 bp, Artificial Sequence
  Synthetic
gatgttgtgatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacattactccgtacacttttggccaggggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 181 - protein, 214 aa, Artificial Sequence
  Synthetic
DVVMTQSPSSLSASVGDRVTITCRASQSISSYLNWYQQKPGKAPKLLIYAASSLQSGVPSRFSGSGSGTDFTLTISSLQPEDFATYYCQQSYITPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 182 - DNA, 1356 bp, Artificial Sequence
  Synthetic
gaagtgcagctggtggagtctgggggaggcttggtacagcctggcaggtccctgagactctcctgtgcagcctctggattcacctttgatgattatgccatgtactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgcggacacggccttgtattactgtgcaaaagataaagactggaactcgagaggttactactactacggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 183 - protein, 451 aa, Artificial Sequence
  Synthetic
EVQLVESGGGLVQPGRSLRLSCAASGFTFDDYAMYWVRQAPGKGLEWVSGISWNSGSIGYADSVKGRFTISRDNAKNSLYLQMNSLRAADTALYYCAKDKDWNSRGYYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 184 - DNA, 348 bp, Artificial Sequence
  Synthetic
gaggtgcagctggtggagtctggaggaggcttggtccagtctggggggtccctgagactctcctgtgcagcctctgggctcaccgtcagtagcaactacatgagctgggtccgccaggctccagggaagggactggagtgggtctcagttatttatagcggtggtagcacattctactcagactccgtgaagggccgattcaccatctccagacacaattccaagaacacgctgtatcttcaaatgaacagcctgagagctgaggacacggccgtgtattactgtgcgagagcgaggggagacgcttttgatatctggggccaagggacaatggtcaccgtctcttca

SEQ ID NO: 185 - protein, 116 aa, Artificial Sequence
  Synthetic
EVQLVESGGGLVQSGGSLRLSCAASGLTVSSNYMSWVRQAPGKGLEWVSVIYSGGSTFYSDSVKGRFTISRHNSKNTLYLQMNSLRAEDTAVYYCARARGDAFDIWGQGTMVTVSS

SEQ ID NO: 186 - DNA, 24 bp, Artificial Sequence
  Synthetic
gggctcaccgtcagtagcaactac

SEQ ID NO: 187 - protein, 8 aa, Artificial Sequence
  Synthetic
GLTVSSNY

SEQ ID NO: 188 - DNA, 30 bp, Artificial Sequence
  Synthetic
gcgagagcgaggggagacgcttttgatatc

SEQ ID NO: 189 - protein, 10 aa, Artificial Sequence
  Synthetic
ARARGDAFDI

SEQ ID NO: 190 - DNA, 324 bp, Artificial Sequence
  Synthetic
gacatccagatgacccagtctccatcctccctgtctgcatctgtgggagacagagtcaccatcacttgccaggcgagtcagggcattagcaactatttaaattggtatcagcagaaaccagggaaagcccctaaactcctgatctccgatgcatccaatttggaaacaggggtcccatcaaggttcagtggaagtggatctgggacagattttactttcaccatcagcagcctgcagcctgaggatattgcaacatattactgtcaacagtatgataatctccgctttttcactttcggccctgggaccaaagtggatatcaaa

SEQ ID NO: 191 - protein, 108 aa, Artificial Sequence
  Synthetic
DIQMTQSPSSLSASVGDRVTITCQASQGISNYLNWYQQKPGKAPKLLISDASNLETGVPSRFSGSGSGTDFTFTISSLQPEDIATYYCQQYDNLRFFTFGPGTKVDIK

SEQ ID NO: 192 - DNA, 18 bp, Artificial Sequence
  Synthetic
cagggcattagcaactat

SEQ ID NO: 193 - DNA, 9 bp, Artificial Sequence
  Synthetic
gatgcatcc

SEQ ID NO: 194 - protein, 3 aa, Artificial Sequence
  Synthetic
DAS

SEQ ID NO: 195 - DNA, 30 bp, Artificial Sequence
  Synthetic
caacagtatgataatctccgctttttcact

SEQ ID NO: 196 - protein, 10 aa, Artificial Sequence
  Synthetic
QQYDNLRFFT

SEQ ID NO: 197 - DNA, 1341 bp, Artificial Sequence
  Synthetic
gaggtgcagctggtggagtctggaggaggcttggtccagtctggggggtccctgagactctcctgtgcagcctctgggctcaccgtcagtagcaactacatgagctgggtccgccaggctccagggaagggactggagtgggtctcagttatttatagcggtggtagcacattctactcagactccgtgaagggccgattcaccatctccagacacaattccaagaacacgctgtatcttcaaatgaacagcctgagagctgaggacacggccgtgtattactgtgcgagagcgaggggagacgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 198 - protein, 446 aa, Artificial Sequence
  Synthetic
EVQLVESGGGLVQSGGSLRLSCAASGLTVSSNYMSWVRQAPGKGLEWVSVIYSGGSTFYSDSVKGRFTISRHNSKNTLYLQMNSLRAEDTAVYYCARARGDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 199 - DNA, 648 bp, Artificial Sequence
  Synthetic
gacatccagatgacccagtctccatcctccctgtctgcatctgtgggagacagagtcaccatcacttgccaggcgagtcagggcattagcaactatttaaattggtatcagcagaaaccagggaaagcccctaaactcctgatctccgatgcatccaatttggaaacaggggtcccatcaaggttcagtggaagtggatctgggacagattttactttcaccatcagcagcctgcagcctgaggatattgcaacatattactgtcaacagtatgataatctccgctttttcactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 200 - protein, 215 aa, Artificial Sequence
  Synthetic
DIQMTQSPSSLSASVGDRVTITCQASQGISNYLNWYQQKPGKAPKLLISDASNLETGVPSRFSGSGSGTDFTFTISSLQPEDIATYYCQQYDNLRFFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 201 - DNA, 360 bp, Artificial Sequence
  Synthetic
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattacttatagtggtagtaccatatactacgcagactctgtgaagggccgattcaccatctccagggacaacgccaagagctcactgtatctgcaaatgaacagcctgagagccgaggacacggccgtgtattactgtgcgagagatcgcggtacaactatggtcccctttgactactggggccagggaaccctggtcaccgtctcctca

SEQ ID NO: 202 - protein, 120 aa, Artificial Sequence
  Synthetic
QVQLVESGGGLVKPGGSLRLSCAASGFTFSDYYMSWIRQAPGKGLEWVSYITYSGSTIYYADSVKGRFTISRDNAKSSLYLQMNSLRAEDTAVYYCARDRGTTMVPFDYWGQGTLVTVSS

SEQ ID NO: 203 - DNA, 24 bp, Artificial Sequence
  Synthetic
ggattcaccttcagtgactactac

SEQ ID NO: 204 - protein, 8 aa, Artificial Sequence
  Synthetic
GFTFSDYY

SEQ ID NO: 205 - DNA, 24 bp, Artificial Sequence
  Synthetic
attacttatagtggtagtaccata

SEQ ID NO: 206 - protein, 8 aa, Artificial Sequence
  Synthetic
ITYSGSTI

SEQ ID NO: 207 - DNA, 39 bp, Artificial Sequence
  Synthetic
gcgagagatcgcggtacaactatggtcccctttgactac

SEQ ID NO: 208 - protein, 13 aa, Artificial Sequence
  Synthetic
ARDRGTTMVPFDY

SEQ ID NO: 209 - DNA, 321 bp, Artificial Sequence
  Synthetic
gacatccagatgacccagtctccatcctccctgtctgcatctgtaggagacagagtcaccatcacttgccaggcgagtcaggacattaccaactatttaaattggtatcagcagaaaccagggaaagcccctaagctcctgatctacgctgcatccaatttggaaacaggggtcccatcaaggttcagtggaagtggatctgggacagattttactttcaccatcagcggcctgcagcctgaagatattgcaacatattactgtcaacagtatgataatctccctctcactttcggcggagggaccaaggtggagatcaaa

SEQ ID NO: 210 - protein, 107 aa, Artificial Sequence
  Synthetic
DIQMTQSPSSLSASVGDRVTITCQASQDITNYLNWYQQKPGKAPKLLIYAASNLETGVPSRFSGSGSGTDFTFTISGLQPEDIATYYCQQYDNLPLTFGGGTKVEIK

SEQ ID NO: 211 - DNA, 18 bp, Artificial Sequence
  Synthetic
caggacattaccaactat

SEQ ID NO: 212 - protein, 6 aa, Artificial Sequence
  Synthetic
QDITNY

SEQ ID NO: 213 - DNA, 27 bp, Artificial Sequence
  Synthetic
caacagtatgataatctccctctcact

SEQ ID NO: 214 - protein, 9 aa, Artificial Sequence
  Synthetic
QQYDNLPLT

SEQ ID NO: 215 - DNA, 1353 bp, Artificial Sequence
  Synthetic
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattacttatagtggtagtaccatatactacgcagactctgtgaagggccgattcaccatctccagggacaacgccaagagctcactgtatctgcaaatgaacagcctgagagccgaggacacggccgtgtattactgtgcgagagatcgcggtacaactatggtcccctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 216 - protein, 450 aa, Artificial Sequence
  Synthetic
QVQLVESGGGLVKPGGSLRLSCAASGFTFSDYYMSWIRQAPGKGLEWVSYITYSGSTIYYADSVKGRFTISRDNAKSSLYLQMNSLRAEDTAVYYCARDRGTTMVPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 217 - DNA, 645 bp, Artificial Sequence
  Synthetic
gacatccagatgacccagtctccatcctccctgtctgcatctgtaggagacagagtcaccatcacttgccaggcgagtcaggacattaccaactatttaaattggtatcagcagaaaccagggaaagcccctaagctcctgatctacgctgcatccaatttggaaacaggggtcccatcaaggttcagtggaagtggatctgggacagattttactttcaccatcagcggcctgcagcctgaagatattgcaacatattactgtcaacagtatgataatctccctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 218 - protein, 214 aa, Artificial Sequence
  Synthetic
DIQMTQSPSSLSASVGDRVTITCQASQDITNYLNWYQQKPGKAPKLLIYAASNLETGVPSRFSGSGSGTDFTFTISGLQPEDIATYYCQQYDNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 219 - DNA, 360 bp, Artificial Sequence
  Synthetic
gaggtgcagctggtggagtctgggggaggcttggtaaagcctggggggtcccttagactctcctgtgcagcctctggaatcactttcagtaacgcctggatgagttgggtccgccaggctccagggaaggggctggagtgggttggccgtattaaaagcaaaactgatggtgggacaacagactacgccgcacccgtgaaaggcagattcaccatctcaagagatgattcaaaaaacacgctgtatctacaaatgaacagcctgaaaaccgaggacacagccgtgtattactgtaccacagcgaggtgggactggtacttcgatctctggggccgtggcaccctggtcactgtctcctca

SEQ ID NO: 220 - protein, 120 aa, Artificial Sequence
  Synthetic
EVQLVESGGGLVKPGGSLRLSCAASGITFSNAWMSWVRQAPGKGLEWVGRIKSKTDGGTTDYAAPVKGRFTISRDDSKNTLYLQMNSLKTEDTAVYYCTTARWDWYFDLWGRGTLVTVSS

SEQ ID NO: 221 - DNA, 24 bp, Artificial Sequence
  Synthetic
ggaatcactttcagtaacgcctgg

SEQ ID NO: 222 - protein, 8 aa, Artificial Sequence
  Synthetic
GITFSNAW

SEQ ID NO: 223 - DNA, 30 bp, Artificial Sequence
  Synthetic
attaaaagcaaaactgatggtgggacaaca

SEQ ID NO: 224 - protein, 10 aa, Artificial Sequence
  Synthetic
IKSKTDGGTT

SEQ ID NO: 225 - DNA, 33 bp, Artificial Sequence
  Synthetic
accacagcgaggtgggactggtacttcgatctc

SEQ ID NO: 226 - protein, 11 aa, Artificial Sequence
  Synthetic
TTARWDWYFDL

SEQ ID NO: 227 - DNA, 321 bp, Artificial Sequence
  Synthetic
gacatccagatgacccagtctccatcctccctgtctgcatctgtaggagacagagtcaccatcacttgccaggcgagtcaggacatttggaattatataaattggtatcagcagaaaccagggaaggcccctaagctcctgatctacgatgcatccaatttgaaaacaggggtcccatcaaggttcagtggaagtggatctgggacagattttactttcaccatcagcagcctgcagcctgaagatattgcaacatattactgtcaacagcatgatgatctccctccgaccttcggccaagggaccaaggtggaaatcaaa

SEQ ID NO: 228 - protein, 107 aa, Artificial Sequence
  Synthetic
DIQMTQSPSSLSASVGDRVTITCQASQDIWNYINWYQQKPGKAPKLLIYDASNLKTGVPSRFSGSGSGTDFTFTISSLQPEDIATYYCQQHDDLPPTFGQGTKVEIK

SEQ ID NO: 229 - DNA, 18 bp, Artificial Sequence
  Synthetic
caggacatttggaattat

SEQ ID NO: 230 - protein, 6 aa, Artificial Sequence
  Synthetic
QDIWNY

SEQ ID NO: 231 - DNA, 27 bp, Artificial Sequence
  Synthetic
caacagcatgatgatctccctccgacc

SEQ ID NO: 232 - protein, 9 aa, Artificial Sequence
  Synthetic
QQHDDLPPT

SEQ ID NO: 233 - DNA, 1353 bp, Artificial Sequence
  Synthetic
gaggtgcagctggtggagtctgggggaggcttggtaaagcctggggggtcccttagactctcctgtgcagcctctggaatcactttcagtaacgcctggatgagttgggtccgccaggctccagggaaggggctggagtgggttggccgtattaaaagcaaaactgatggtgggacaacagactacgccgcacccgtgaaaggcagattcaccatctcaagagatgattcaaaaaacacgctgtatctacaaatgaacagcctgaaaaccgaggacacagccgtgtattactgtaccacagcgaggtgggactggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 234 - protein, 450 aa, Artificial Sequence
  Synthetic
EVQLVESGGGLVKPGGSLRLSCAASGITFSNAWMSWVRQAPGKGLEWVGRIKSKTDGGTTDYAAPVKGRFTISRDDSKNTLYLQMNSLKTEDTAVYYCTTARWDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 235 - DNA, 645 bp, Artificial Sequence
  Synthetic
gacatccagatgacccagtctccatcctccctgtctgcatctgtaggagacagagtcaccatcacttgccaggcgagtcaggacatttggaattatataaattggtatcagcagaaaccagggaaggcccctaagctcctgatctacgatgcatccaatttgaaaacaggggtcccatcaaggttcagtggaagtggatctgggacagattttactttcaccatcagcagcctgcagcctgaagatattgcaacatattactgtcaacagcatgatgatctccctccgaccttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 236 - protein, 214 aa, Artificial Sequence
  Synthetic
DIQMTQSPSSLSASVGDRVTITCQASQDIWNYINWYQQKPGKAPKLLIYDASNLKTGVPSRFSGSGSGTDFTFTISSLQPEDIATYYCQQHDDLPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 237 - DNA, 360 bp, Artificial Sequence
  Synthetic
gaggtgcagctggtggagtctggaggaggcttggtccagcctggggggtccctgagactctcctgtgcagcctctgggttcaccgtcagtagcaactacatgagctgggtccgccaggctccagggaaggggctggagtgggtctcacttatttatagcggtggtagcacatactatgcagactccgtgaagggccgattcaccatctccagacacaattccaagaacacgctgtatcttcaaatgaacagcctgagatctgaggacacggccgtgtattactgtgcgagagtccccctgggggattactactacggtatggacgtctggggccaagggaccacggtcaccgtctcctca

SEQ ID NO: 238 - protein, 120 aa, Artificial Sequence
  Synthetic
EVQLVESGGGLVQPGGSLRLSCAASGFTVSSNYMSWVRQAPGKGLEWVSLIYSGGSTYYADSVKGRFTISRHNSKNTLYLQMNSLRSEDTAVYYCARVPLGDYYYGMDVWGQGTTVTVSS

SEQ ID NO: 239 - DNA, 42 bp, Artificial Sequence
  Synthetic
gcgagagtccccctgggggattactactacggtatggacgtc

SEQ ID NO: 240 - protein, 14 aa, Artificial Sequence
  Synthetic
ARVPLGDYYYGMDV

SEQ ID NO: 241 - DNA, 321 bp, Artificial Sequence
  Synthetic
gacatccagatgacccagtctccatcctccctgtctgcatctgtaggagacagagtcaccatcacttgccaggcgagtcaggacattaacaagtatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtctgataatctccctctcactttcggcggagggaccaaggtggagatcaaa

SEQ ID NO: 242 - protein, 107 aa, Artificial Sequence
  Synthetic
DIQMTQSPSSLSASVGDRVTITCQASQDINKYLNWYQQKPGKAPKLLIYDASNLETGVPSRFSGSGSGTDFTFTISSLQPEDIATYYCQQSDNLPLTFGGGTKVEIK

SEQ ID NO: 243 - DNA, 18 bp, Artificial Sequence
  Synthetic
caggacattaacaagtat

SEQ ID NO: 244 - protein, 6 aa, Artificial Sequence
  Synthetic
QDINKY

SEQ ID NO: 245 - DNA, 27 bp, Artificial Sequence
  Synthetic
caacagtctgataatctccctctcact

SEQ ID NO: 246 - protein, 9 aa, Artificial Sequence
  Synthetic
QQSDNLPLT

SEQ ID NO: 247 - DNA, 1353 bp, Artificial Sequence
  Synthetic
gaggtgcagctggtggagtctggaggaggcttggtccagcctggggggtccctgagactctcctgtgcagcctctgggttcaccgtcagtagcaactacatgagctgggtccgccaggctccagggaaggggctggagtgggtctcacttatttatagcggtggtagcacatactatgcagactccgtgaagggccgattcaccatctccagacacaattccaagaacacgctgtatcttcaaatgaacagcctgagatctgaggacacggccgtgtattactgtgcgagagtccccctgggggattactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 248 - protein, 450 aa, Artificial Sequence
  Synthetic
EVQLVESGGGLVQPGGSLRLSCAASGFTVSSNYMSWVRQAPGKGLEWVSLIYSGGSTYYADSVKGRFTISRHNSKNTLYLQMNSLRSEDTAVYYCARVPLGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 249 - DNA, 645 bp, Artificial Sequence
  Synthetic
gacatccagatgacccagtctccatcctccctgtctgcatctgtaggagacagagtcaccatcacttgccaggcgagtcaggacattaacaagtatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtctgataatctccctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 250 - protein, 214 aa, Artificial Sequence
  Synthetic
DIQMTQSPSSLSASVGDRVTITCQASQDINKYLNWYQQKPGKAPKLLIYDASNLETGVPSRFSGSGSGTDFTFTISSLQPEDIATYYCQQSDNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 251 - DNA, 372 bp, Artificial Sequence
  Synthetic
caggtgcagctggtggagtctgggggaggcgtggtccagcctgggaggtccctgagactctcctgtgcagcgtctggattcaccttcagaaactatggcatgcactgggtccgccaggctccaggcaaggggctggagtgggtgtcagttatatggtatgatggaagtaatagatactatgcagactccgtgaagggccgattcaccatctccagagacacttccaagaacacgctgtatctgcaaatgaacagcctgagagccgaagacacggctgtgtattactgtgcgagagatcctcctataactggaacgacggggggcgatgcttttgatatctggggccaagggacaatggtcaccgtctcttca

SEQ ID NO: 252 - protein, 124 aa, Artificial Sequence
  Synthetic
QVQLVESGGGVVQPGRSLRLSCAASGFTFRNYGMHWVRQAPGKGLEWVSVIWYDGSNRYYADSVKGRFTISRDTSKNTLYLQMNSLRAEDTAVYYCARDPPITGTTGGDAFDIWGQGTMVTVSS

SEQ ID NO: 253 - DNA, 24 bp, Artificial Sequence
  Synthetic
ggattcaccttcagaaactatggc

SEQ ID NO: 254 - protein, 8 aa, Artificial Sequence
  Synthetic
GFTFRNYG

SEQ ID NO: 255 - DNA, 24 bp, Artificial Sequence
  Synthetic
atatggtatgatggaagtaataga

SEQ ID NO: 256 - protein, 8 aa, Artificial Sequence
  Synthetic
IWYDGSNR

SEQ ID NO: 257 - DNA, 51 bp, Artificial Sequence
  Synthetic
gcgagagatcctcctataactggaacgacggggggcgatgcttttgatatc

SEQ ID NO: 258 - protein, 17 aa, Artificial Sequence
  Synthetic
ARDPPITGTTGGDAFDI

SEQ ID NO: 259 - DNA, 321 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctcacctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtactccttacacttttggccaggggaccaagctggagatcaaa

SEQ ID NO: 260 - protein, 107 aa, Artificial Sequence
  Synthetic
DIQMTQSPSSLSASVGDRVTITCRASQSISSYLNWYQQKPGKAPHLLIYAASSLQSGVPSRFSGSGSGTDFTLTISSLQPEDFATYYCQQSYSTPYTFGQGTKLEIK

SEQ ID NO: 261 - DNA, 27 bp, Artificial Sequence
  Synthetic
caacagagttacagtactccttacact

SEQ ID NO: 262 - protein, 9 aa, Artificial Sequence
  Synthetic
QQSYSTPYT

SEQ ID NO: 263 - DNA, 1365 bp, Artificial Sequence
  Synthetic
caggtgcagctggtggagtctgggggaggcgtggtccagcctgggaggtccctgagactctcctgtgcagcgtctggattcaccttcagaaactatggcatgcactgggtccgccaggctccaggcaaggggctggagtgggtgtcagttatatggtatgatggaagtaatagatactatgcagactccgtgaagggccgattcaccatctccagagacacttccaagaacacgctgtatctgcaaatgaacagcctgagagccgaagacacggctgtgtattactgtgcgagagatcctcctataactggaacgacggggggcgatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 264 - protein, 454 aa, Artificial Sequence
  Synthetic
QVQLVESGGGVVQPGRSLRLSCAASGFTFRNYGMHWVRQAPGKGLEWVSVIWYDGSNRYYADSVKGRFTISRDTSKNTLYLQMNSLRAEDTAVYYCARDPPITGTTGGDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 265 - DNA, 645 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctcacctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtactccttacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 266 - protein, 214 aa, Artificial Sequence
  Synthetic
DIQMTQSPSSLSASVGDRVTITCRASQSISSYLNWYQQKPGKAPHLLIYAASSLQSGVPSRFSGSGSGTDFTLTISSLQPEDFATYYCQQSYSTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 267 - DNA, 357 bp, Artificial Sequence
  Synthetic
cagatcaccttgaaggagtctggtcctacgctggtgaaacccacacagaccctcacgctgacctgcaccttctctgggttctcactcagcactaatgtagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacggcccaactggggactactttgactactggggccagggaaccctggtcaccgtctcctca

SEQ ID NO: 268 - protein, 119 aa, Artificial Sequence
  Synthetic
QITLKESGPTLVKPTQTLTLTCTFSGFSLSTNVVGVGWIRQPPGKALEWLALIYWNDDKRYSPSLKSRLTITKDTSKNQVVLTMTNMDPVDTATYYCAHGPTGDYFDYWGQGTLVTVSS

SEQ ID NO: 269 - DNA, 30 bp, Artificial Sequence
  Synthetic
gggttctcactcagcactaatgtagtgggt

SEQ ID NO: 270 - protein, 10 aa, Artificial Sequence
  Synthetic
GFSLSTNVVG

SEQ ID NO: 271 - DNA, 21 bp, Artificial Sequence
  Synthetic
atttattggaatgatgataag

SEQ ID NO: 272 - protein, 7 aa, Artificial Sequence
  Synthetic
IYWNDDK

SEQ ID NO: 273 - DNA, 33 bp, Artificial Sequence
  Synthetic
gcacacggcccaactggggactactttgactac

SEQ ID NO: 274 - protein, 11 aa, Artificial Sequence
  Synthetic
AHGPTGDYFDY

SEQ ID NO: 275 - DNA, 324 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttacaaagtggggtcccatcaaggttcagtggcagtggatctgggacagatttcactctcaccatcagcagtctgcaacctgaagattttgcaacttactactgtcaacagacttacagtaccctcatgtacacttttggccaggggaccaagctggagatcaaa

SEQ ID NO: 276 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQTYSTLMYTFGQGTKLEIK

SEQ ID NO: 277 - DNA, 30 bp, Artificial Sequence
  Synthetic
caacagacttacagtaccctcatgtacact

SEQ ID NO: 278 - protein, 10 aa, Artificial Sequence
  Synthetic
QQTYSTLMYT

SEQ ID NO: 279 - DNA, 1350 bp, Artificial Sequence
  Synthetic
cagatcaccttgaaggagtctggtcctacgctggtgaaacccacacagaccctcacgctgacctgcaccttctctgggttctcactcagcactaatgtagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacggcccaactggggactactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 280 - protein, 449 aa, Artificial Sequence
  Synthetic
QITLKESGPTLVKPTQTLTLTCTFSGFSLSTNVVGVGWIRQPPGKALEWLALIYWNDDKRYSPSLKSRLTITKDTSKNQVVLTMTNMDPVDTATYYCAHGPTGDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 281 - DNA, 648 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttacaaagtggggtcccatcaaggttcagtggcagtggatctgggacagatttcactctcaccatcagcagtctgcaacctgaagattttgcaacttactactgtcaacagacttacagtaccctcatgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 282 - protein, 215 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQTYSTLMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 283 - DNA, 366 bp, Artificial Sequence
  Synthetic
gaagtgcagctggtggagtctgggggaggcttggttcagcctggcaggtccctgagactctcctgtgcagcctctggattcacctttgatgattatgccatgcactgggtccggcaagctccagggaagggcctggagtgggtctcaggtgttagttggaatagtggtaccatagactatgcggactctgtgaagggccgattcaccattattagagacaacgctaagaactccctgtatctgcaaatgaacagtctgagagctgaagacacggccttgtattactgttcaaaagatatggggaggctagactactactccggtttggacgtctggggccaagggaccacggtcaccgtctcctca

SEQ ID NO: 284 - protein, 122 aa, Artificial Sequence
  Synthetic
EVQLVESGGGLVQPGRSLRLSCAASGFTFDDYAMHWVRQAPGKGLEWVSGVSWNSGTIDYADSVKGRFTIIRDNAKNSLYLQMNSLRAEDTALYYCSKDMGRLDYYSGLDVWGQGTTVTVSS

SEQ ID NO: 285 - DNA, 24 bp, Artificial Sequence
  Synthetic
gttagttggaatagtggtaccata

SEQ ID NO: 286 - protein, 8 aa, Artificial Sequence
  Synthetic
VSWNSGTI

SEQ ID NO: 287 - DNA, 45 bp, Artificial Sequence
  Synthetic
tcaaaagatatggggaggctagactactactccggtttggacgtc

SEQ ID NO: 288 - protein, 15 aa, Artificial Sequence
  Synthetic
SKDMGRLDYYSGLDV

SEQ ID NO: 289 - DNA, 324 bp, Artificial Sequence
  Synthetic
gaaatagtgttgacgcagtctccaggcaccctgtctttgtctccaggggaaagagccaccctctcctgcagggccagtcagagtgttagcagcagcgactttgcctggtaccagcagaaacctggccaggctcccaggctcctcatctatggtgcatccagcagggccactggtatcccagacaggttcagtggcagtgggtctgggacagatttcactctcaccatcagcagactggagcctgaagattttgcagtgtattactgtcagcagtatggtagctcaccttggacgttcggccaagggaccaaggtggaaatcaaa

SEQ ID NO: 290 - protein, 108 aa, Artificial Sequence
  Synthetic
EIVLTQSPGTLSLSPGERATLSCRASQSVSSSDFAWYQQKPGQAPRLLIYGASSRATGIPDRFSGSGSGTDFTLTISRLEPEDFAVYYCQQYGSSPWTFGQGTKVEIK

SEQ ID NO: 291 - DNA, 21 bp, Artificial Sequence
  Synthetic
cagagtgttagcagcagcgac

SEQ ID NO: 292 - protein, 7 aa, Artificial Sequence
  Synthetic
QSVSSSD

SEQ ID NO: 293 - DNA, 9 bp, Artificial Sequence
  Synthetic
ggtgcatcc

SEQ ID NO: 294 - protein, 3 aa, Artificial Sequence
  Synthetic
GAS

SEQ ID NO: 295 - DNA, 27 bp, Artificial Sequence
  Synthetic
cagcagtatggtagctcaccttggacg

SEQ ID NO: 296 - protein, 9 aa, Artificial Sequence
  Synthetic
QQYGSSPWT

SEQ ID NO: 297 - DNA, 1359 bp, Artificial Sequence
  Synthetic
gaagtgcagctggtggagtctgggggaggcttggttcagcctggcaggtccctgagactctcctgtgcagcctctggattcacctttgatgattatgccatgcactgggtccggcaagctccagggaagggcctggagtgggtctcaggtgttagttggaatagtggtaccatagactatgcggactctgtgaagggccgattcaccattattagagacaacgctaagaactccctgtatctgcaaatgaacagtctgagagctgaagacacggccttgtattactgttcaaaagatatggggaggctagactactactccggtttggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 298 - protein, 452 aa, Artificial Sequence
  Synthetic
EVQLVESGGGLVQPGRSLRLSCAASGFTFDDYAMHWVRQAPGKGLEWVSGVSWNSGTIDYADSVKGRFTIIRDNAKNSLYLQMNSLRAEDTALYYCSKDMGRLDYYSGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 299 - DNA, 648 bp, Artificial Sequence
  Synthetic
gaaatagtgttgacgcagtctccaggcaccctgtctttgtctccaggggaaagagccaccctctcctgcagggccagtcagagtgttagcagcagcgactttgcctggtaccagcagaaacctggccaggctcccaggctcctcatctatggtgcatccagcagggccactggtatcccagacaggttcagtggcagtgggtctgggacagatttcactctcaccatcagcagactggagcctgaagattttgcagtgtattactgtcagcagtatggtagctcaccttggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 300 - protein, 215 aa, Artificial Sequence
  Synthetic
EIVLTQSPGTLSLSPGERATLSCRASQSVSSSDFAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 301 - DNA, 354 bp, Artificial Sequence
  Synthetic
gaggtgcagctggtggagtctggaggaggcttggtccagcctggggggtccctgagactctcctgtgcagtctctgggttcaccgtcagtagcaactacatgagctgggtccgccaggctccagggaagggactggaatgggtctcacttatttatagcggtggtagcacattctacgcagactccgtgaagggccgattcaccatctccagacacaattccaagaacacgctgtatcttcaaatgaacagcctgagagctgaggacacggccgtatattactgtgcgagagaaggtggatacagctatgattacaactactggggccagggaaccctggtcaccgtctcctca

SEQ ID NO: 302 - protein, 118 aa, Artificial Sequence
  Synthetic
EVQLVESGGGLVQPGGSLRLSCAVSGFTVSSNYMSWVRQAPGKGLEWVSLIYSGGSTFYADSVKGRFTISRHNSKNTLYLQMNSLRAEDTAVYYCAREGGYSYDYNYWGQGTLVTVSS

SEQ ID NO: 303 - DNA, 36 bp, Artificial Sequence
  Synthetic
gcgagagaaggtggatacagctatgattacaactac

SEQ ID NO: 304 - protein, 12 aa, Artificial Sequence
  Synthetic
AREGGYSYDYNY

SEQ ID NO: 305 - DNA, 321 bp, Artificial Sequence
  Synthetic
gacatccagatgacccagtctccatcctccctgtccgcatctgtaggagacagagtcaccatcacgtgccaggcgagtcaggacattagaaactatttaaattggtatcagcagaaaccagggaaagcccctaagctcctgatctacgatgcatccaatttggaaacaggggtcccatcaaggttcagtggaattggatctgggacagattttactttcaccatcagcagcctgcagcctgaagatattgcaacatattactgtcaacagtatgataacctccctatcaccttcggccaagggacacgactggagattaaa

SEQ ID NO: 306 - protein, 107 aa, Artificial Sequence
  Synthetic
DIQMTQSPSSLSASVGDRVTITCQASQDIRNYLNWYQQKPGKAPKLLIYDASNLETGVPSRFSGIGSGTDFTFTISSLQPEDIATYYCQQYDNLPITFGQGTRLEIK

SEQ ID NO: 307 - DNA, 18 bp, Artificial Sequence
  Synthetic
caggacattagaaactat

SEQ ID NO: 308 - protein, 6 aa, Artificial Sequence
  Synthetic
QDIRNY

SEQ ID NO: 309 - DNA, 27 bp, Artificial Sequence
  Synthetic
caacagtatgataacctccctatcacc

SEQ ID NO: 310 - protein, 9 aa, Artificial Sequence
  Synthetic
QQYDNLPIT

SEQ ID NO: 311 - DNA, 1347 bp, Artificial Sequence
  Synthetic
gaggtgcagctggtggagtctggaggaggcttggtccagcctggggggtccctgagactctcctgtgcagtctctgggttcaccgtcagtagcaactacatgagctgggtccgccaggctccagggaagggactggaatgggtctcacttatttatagcggtggtagcacattctacgcagactccgtgaagggccgattcaccatctccagacacaattccaagaacacgctgtatcttcaaatgaacagcctgagagctgaggacacggccgtatattactgtgcgagagaaggtggatacagctatgattacaactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 312 - protein, 448 aa, Artificial Sequence
  Synthetic
EVQLVESGGGLVQPGGSLRLSCAVSGFTVSSNYMSWVRQAPGKGLEWVSLIYSGGSTFYADSVKGRFTISRHNSKNTLYLQMNSLRAEDTAVYYCAREGGYSYDYNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 313 - DNA, 645 bp, Artificial Sequence
  Synthetic
gacatccagatgacccagtctccatcctccctgtccgcatctgtaggagacagagtcaccatcacgtgccaggcgagtcaggacattagaaactatttaaattggtatcagcagaaaccagggaaagcccctaagctcctgatctacgatgcatccaatttggaaacaggggtcccatcaaggttcagtggaattggatctgggacagattttactttcaccatcagcagcctgcagcctgaagatattgcaacatattactgtcaacagtatgataacctccctatcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 314 - protein, 214 aa, Artificial Sequence
  Synthetic
DIQMTQSPSSLSASVGDRVTITCQASQDIRNYLNWYQQKPGKAPKLLIYDASNLETGVPSRFSGIGSGTDFTFTISSLQPEDIATYYCQQYDNLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 315 - DNA, 351 bp, Artificial Sequence
  Synthetic
gaggtgcagctggtggagtctggaggaggcttggtccagccgggggggtccctgagactctcctgtgcagcctctgggttaaccgtcagtagcaactacatgaactgggtccgccaggttccagggaaggggctggagtgggtctcagttatttatagcggtggtagtaaattctacgtagactccgtgaagggccgattcaccatctccagacacaattccaagaacacgctgtatcttcaaatgaacagcctgagacctgaggacacggccgtgtattactgtacgcgagacgcgcaatactacggtatggacgtctggggccaagggaccacggtcaccgtctcctca

SEQ ID NO: 316 - protein, 117 aa, Artificial Sequence
  Synthetic
EVQLVESGGGLVQPGGSLRLSCAASGLTVSSNYMNWVRQVPGKGLEWVSVIYSGGSKFYVDSVKGRFTISRHNSKNTLYLQMNSLRPEDTAVYYCTRDAQYYGMDVWGQGTTVTVSS

SEQ ID NO: 317 - DNA, 24 bp, Artificial Sequence
  Synthetic
gggttaaccgtcagtagcaactac

SEQ ID NO: 318 - DNA, 21 bp, Artificial Sequence
  Synthetic
atttatagcggtggtagtaaa

SEQ ID NO: 319 - protein, 7 aa, Artificial Sequence
  Synthetic
IYSGGSK

SEQ ID NO: 320 - DNA, 33 bp, Artificial Sequence
  Synthetic
acgcgagacgcgcaatactacggtatggacgtc

SEQ ID NO: 321 - protein, 11 aa, Artificial Sequence
  Synthetic
TRDAQYYGMDV

SEQ ID NO: 322 - DNA, 324 bp, Artificial Sequence
  Synthetic
gacatccagatgacccagtctccatcctccctgtctgcatctgtgggagacagagtcaccatcacttgccgggcaagtcagagcattagcacctatttacattggtatcagcagaaaccaggagaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccggagatttttggccaggggaccaagctggagatcaaa

SEQ ID NO: 323 - protein, 108 aa, Artificial Sequence
  Synthetic
DIQMTQSPSSLSASVGDRVTITCRASQSISTYLHWYQQKPGEAPKLLIYAASSLQSGVPSRFSGSGSGTDFTLTISSLQPEDFATYYCQQSYSTPPEIFGQGTKLEIK

SEQ ID NO: 324 - DNA, 18 bp, Artificial Sequence
  Synthetic
cagagcattagcacctat

SEQ ID NO: 325 - protein, 6 aa, Artificial Sequence
  Synthetic
QSISTY

SEQ ID NO: 326 - DNA, 30 bp, Artificial Sequence
  Synthetic
caacagagttacagtacccctccggagatt

SEQ ID NO: 327 - protein, 10 aa, Artificial Sequence
  Synthetic
QQSYSTPPEI

SEQ ID NO: 328 - DNA, 1344 bp, Artificial Sequence
  Synthetic
gaggtgcagctggtggagtctggaggaggcttggtccagccgggggggtccctgagactctcctgtgcagcctctgggttaaccgtcagtagcaactacatgaactgggtccgccaggttccagggaaggggctggagtgggtctcagttatttatagcggtggtagtaaattctacgtagactccgtgaagggccgattcaccatctccagacacaattccaagaacacgctgtatcttcaaatgaacagcctgagacctgaggacacggccgtgtattactgtacgcgagacgcgcaatactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 329 - protein, 447 aa, Artificial Sequence
  Synthetic
EVQLVESGGGLVQPGGSLRLSCAASGLTVSSNYMNWVRQVPGKGLEWVSVIYSGGSKFYVDSVKGRFTISRHNSKNTLYLQMNSLRPEDTAVYYCTRDAQYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 330 - DNA, 648 bp, Artificial Sequence
  Synthetic
gacatccagatgacccagtctccatcctccctgtctgcatctgtgggagacagagtcaccatcacttgccgggcaagtcagagcattagcacctatttacattggtatcagcagaaaccaggagaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccggagatttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 331 - protein, 215 aa, Artificial Sequence
  Synthetic
DIQMTQSPSSLSASVGDRVTITCRASQSISTYLHWYQQKPGEAPKLLIYAASSLQSGVPSRFSGSGSGTDFTLTISSLQPEDFATYYCQQSYSTPPEIFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 332 - DNA, 354 bp, Artificial Sequence
  Synthetic
gaggtgcagctggtggagtctggaggaggcttggtccagcctggggggtccctgagactctcctgtgcagcctctgggatcaccgtcagtagcaattacatgacctgggtccgccaggctccagggaaggggctggagtgggtctcagttatttatagcggtggtagcacattctacgcagactccgtgaagggccgattcaccatctccagacacaattccaagaacacgctgtatcttcaaatgaacaacctgagagctgaggacacggccgtgtattactgtgtgagagatctagaggttcggggcggtatggacgtctggggccaagggaccacggtcaccgtctcctca

SEQ ID NO: 333 - protein, 118 aa, Artificial Sequence
  Synthetic
EVQLVESGGGLVQPGGSLRLSCAASGITVSSNYMTWVRQAPGKGLEWVSVIYSGGSTFYADSVKGRFTISRHNSKNTLYLQMNNLRAEDTAVYYCVRDLEVRGGMDVWGQGTTVTVSS

SEQ ID NO: 334 - DNA, 24 bp, Artificial Sequence
  Synthetic
gggatcaccgtcagtagcaattac

SEQ ID NO: 335 - DNA, 36 bp, Artificial Sequence
  Synthetic
gtgagagatctagaggttcggggcggtatggacgtc

SEQ ID NO: 336 - protein, 12 aa, Artificial Sequence
  Synthetic
VRDLEVRGGMDV

SEQ ID NO: 337 - DNA, 324 bp, Artificial Sequence
  Synthetic
gaaattgtgttgacgcagtctccaggcaccctgtctttgtctccaggggaaagagccaccctctcctgcagggccagtcagagttttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccttggacgttcggccaagggaccaaggtggaaatcaaa

SEQ ID NO: 338 - protein, 108 aa, Artificial Sequence
  Synthetic
EIVLTQSPGTLSLSPGERATLSCRASQSFSSSYLAWYQQKPGQAPRLLIYGASSRATGIPDRFSGSGSGTDFTLTISRLEPEDFAVYYCQQYGSSPWTFGQGTKVEIK

SEQ ID NO: 339 - DNA, 21 bp, Artificial Sequence
  Synthetic
cagagttttagcagcagctac

SEQ ID NO: 340 - protein, 7 aa, Artificial Sequence
  Synthetic
QSFSSSY

SEQ ID NO: 341 - DNA, 1347 bp, Artificial Sequence
  Synthetic
gaggtgcagctggtggagtctggaggaggcttggtccagcctggggggtccctgagactctcctgtgcagcctctgggatcaccgtcagtagcaattacatgacctgggtccgccaggctccagggaaggggctggagtgggtctcagttatttatagcggtggtagcacattctacgcagactccgtgaagggccgattcaccatctccagacacaattccaagaacacgctgtatcttcaaatgaacaacctgagagctgaggacacggccgtgtattactgtgtgagagatctagaggttcggggcggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 342 - protein, 448 aa, Artificial Sequence
  Synthetic
EVQLVESGGGLVQPGGSLRLSCAASGITVSSNYMTWVRQAPGKGLEWVSVIYSGGSTFYADSVKGRFTISRHNSKNTLYLQMNNLRAEDTAVYYCVRDLEVRGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 343 - DNA, 648 bp, Artificial Sequence
  Synthetic
gaaattgtgttgacgcagtctccaggcaccctgtctttgtctccaggggaaagagccaccctctcctgcagggccagtcagagttttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccttggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 344 - protein, 215 aa, Artificial Sequence
  Synthetic
EIVLTQSPGTLSLSPGERATLSCRASQSFSSSYLAWYQQKPGQAPRLLIYGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 345 - DNA, 1329 bp, Artificial Sequence
  Synthetic
gaggtgcagctggtggagtctggaggaggcttggtccagtctggggggtccctgagactctcctgtgcagcctctgggctcaccgtcagtagcaactacatgagctgggtccgccaggctccagggaagggactggagtgggtctcagttatttatagcggtggtagcacattctactcagactccgtgaagggccgattcaccatctccagacacaattccaagaacacgctgtatcttcaaatgaacagcctgagagctgaggacacggccgtgtattactgtgcgagagcgaggggagacgcttttgatatctggggccaagggacaatggtcaccgtctcttcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 346 - protein, 442 aa, Artificial Sequence
  Synthetic
EVQLVESGGGLVQSGGSLRLSCAASGLTVSSNYMSWVRQAPGKGLEWVSVIYSGGSTFYSDSVKGRFTISRHNSKNTLYLQMNSLRAEDTAVYYCARARGDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 347 - DNA, 1341 bp, Artificial Sequence
  Synthetic
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattacttatagtggtagtaccatatactacgcagactctgtgaagggccgattcaccatctccagggacaacgccaagagctcactgtatctgcaaatgaacagcctgagagccgaggacacggccgtgtattactgtgcgagagatcgcggtacaactatggtcccctttgactactggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 348 - protein, 446 aa, Artificial Sequence
  Synthetic
QVQLVESGGGLVKPGGSLRLSCAASGFTFSDYYMSWIRQAPGKGLEWVSYITYSGSTIYYADSVKGRFTISRDNAKSSLYLQMNSLRAEDTAVYYCARDRGTTMVPFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 349 - DNA, 1341 bp, Artificial Sequence
  Synthetic
gaggtgcagctggtggagtctgggggaggcttggtaaagcctggggggtcccttagactctcctgtgcagcctctggaatcactttcagtaacgcctggatgagttgggtccgccaggctccagggaaggggctggagtgggttggccgtattaaaagcaaaactgatggtgggacaacagactacgccgcacccgtgaaaggcagattcaccatctcaagagatgattcaaaaaacacgctgtatctacaaatgaacagcctgaaaaccgaggacacagccgtgtattactgtaccacagcgaggtgggactggtacttcgatctctggggccgtggcaccctggtcactgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 350 - protein, 446 aa, Artificial Sequence
  Synthetic
EVQLVESGGGLVKPGGSLRLSCAASGITFSNAWMSWVRQAPGKGLEWVGRIKSKTDGGTTDYAAPVKGRFTISRDDSKNTLYLQMNSLKTEDTAVYYCTTARWDWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 351 - DNA, 1341 bp, Artificial Sequence
  Synthetic
gaggtgcagctggtggagtctggaggaggcttggtccagcctggggggtccctgagactctcctgtgcagcctctgggttcaccgtcagtagcaactacatgagctgggtccgccaggctccagggaaggggctggagtgggtctcacttatttatagcggtggtagcacatactatgcagactccgtgaagggccgattcaccatctccagacacaattccaagaacacgctgtatcttcaaatgaacagcctgagatctgaggacacggccgtgtattactgtgcgagagtccccctgggggattactactacggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 352 - protein, 446 aa, Artificial Sequence
  Synthetic
EVQLVESGGGLVQPGGSLRLSCAASGFTVSSNYMSWVRQAPGKGLEWVSLIYSGGSTYYADSVKGRFTISRHNSKNTLYLQMNSLRSEDTAVYYCARVPLGDYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 353 - DNA, 1353 bp, Artificial Sequence
  Synthetic
caggtgcagctggtggagtctgggggaggcgtggtccagcctgggaggtccctgagactctcctgtgcagcgtctggattcaccttcagaaactatggcatgcactgggtccgccaggctccaggcaaggggctggagtgggtgtcagttatatggtatgatggaagtaatagatactatgcagactccgtgaagggccgattcaccatctccagagacacttccaagaacacgctgtatctgcaaatgaacagcctgagagccgaagacacggctgtgtattactgtgcgagagatcctcctataactggaacgacggggggcgatgcttttgatatctggggccaagggacaatggtcaccgtctcttcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 354 - protein, 450 aa, Artificial Sequence
  Synthetic
QVQLVESGGGVVQPGRSLRLSCAASGFTFRNYGMHWVRQAPGKGLEWVSVIWYDGSNRYYADSVKGRFTISRDTSKNTLYLQMNSLRAEDTAVYYCARDPPITGTTGGDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 355 - DNA, 1338 bp, Artificial Sequence
  Synthetic
cagatcaccttgaaggagtctggtcctacgctggtgaaacccacacagaccctcacgctgacctgcaccttctctgggttctcactcagcactaatgtagtgggtgtgggctggatccgtcagcccccaggaaaggccctggagtggcttgcactcatttattggaatgatgataagcgctacagcccatctctgaagagcaggctcaccatcaccaaggacacctccaaaaaccaggtggtccttacaatgaccaacatggaccctgtggacacagccacatattactgtgcacacggcccaactggggactactttgactactggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 356 - protein, 445 aa, Artificial Sequence
  Synthetic
QITLKESGPTLVKPTQTLTLTCTFSGFSLSTNVVGVGWIRQPPGKALEWLALIYWNDDKRYSPSLKSRLTITKDTSKNQVVLTMTNMDPVDTATYYCAHGPTGDYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 357 - DNA, 1335 bp, Artificial Sequence
  Synthetic
gaggtgcagctggtggagtctggaggaggcttggtccagcctggggggtccctgagactctcctgtgcagtctctgggttcaccgtcagtagcaactacatgagctgggtccgccaggctccagggaagggactggaatgggtctcacttatttatagcggtggtagcacattctacgcagactccgtgaagggccgattcaccatctccagacacaattccaagaacacgctgtatcttcaaatgaacagcctgagagctgaggacacggccgtatattactgtgcgagagaaggtggatacagctatgattacaactactggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 358 - protein, 444 aa, Artificial Sequence
  Synthetic
EVQLVESGGGLVQPGGSLRLSCAVSGFTVSSNYMSWVRQAPGKGLEWVSLIYSGGSTFYADSVKGRFTISRHNSKNTLYLQMNSLRAEDTAVYYCAREGGYSYDYNYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 359 - DNA, 1332 bp, Artificial Sequence
  Synthetic
gaggtgcagctggtggagtctggaggaggcttggtccagccgggggggtccctgagactctcctgtgcagcctctgggttaaccgtcagtagcaactacatgaactgggtccgccaggttccagggaaggggctggagtgggtctcagttatttatagcggtggtagtaaattctacgtagactccgtgaagggccgattcaccatctccagacacaattccaagaacacgctgtatcttcaaatgaacagcctgagacctgaggacacggccgtgtattactgtacgcgagacgcgcaatactacggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 360 - protein, 443 aa, Artificial Sequence
  Synthetic
EVQLVESGGGLVQPGGSLRLSCAASGLTVSSNYMNWVRQVPGKGLEWVSVIYSGGSKFYVDSVKGRFTISRHNSKNTLYLQMNSLRPEDTAVYYCTRDAQYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 361 - DNA, 1335 bp, Artificial Sequence
  Synthetic
gaggtgcagctggtggagtctggaggaggcttggtccagcctggggggtccctgagactctcctgtgcagcctctgggatcaccgtcagtagcaattacatgacctgggtccgccaggctccagggaaggggctggagtgggtctcagttatttatagcggtggtagcacattctacgcagactccgtgaagggccgattcaccatctccagacacaattccaagaacacgctgtatcttcaaatgaacaacctgagagctgaggacacggccgtgtattactgtgtgagagatctagaggttcggggcggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 362 - protein, 444 aa, Artificial Sequence
  Synthetic
EVQLVESGGGLVQPGGSLRLSCAASGITVSSNYMTWVRQAPGKGLEWVSVIYSGGSTFYADSVKGRFTISRHNSKNTLYLQMNNLRAEDTAVYYCVRDLEVRGGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 363 - DNA, 1347 bp, Artificial Sequence
  Synthetic
gaagtgcagctggtggagtctgggggaggcttggttcagcctggcaggtccctgagactctcctgtgcagcctctggattcacctttgatgattatgccatgcactgggtccggcaagctccagggaagggcctggagtgggtctcaggtgttagttggaatagtggtaccatagactatgcggactctgtgaagggccgattcaccattattagagacaacgctaagaactccctgtatctgcaaatgaacagtctgagagctgaagacacggccttgtattactgttcaaaagatatggggaggctagactactactccggtttggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 364 - protein, 448 aa, Artificial Sequence
  Synthetic
EVQLVESGGGLVQPGRSLRLSCAASGFTFDDYAMHWVRQAPGKGLEWVSGVSWNSGTIDYADSVKGRFTIIRDNAKNSLYLQMNSLRAEDTALYYCSKDMGRLDYYSGLDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 365 - DNA, 357 bp, Artificial Sequence
  Synthetic
gaggtgcagctggtggagtctgggggaggcttggtccagcctggggggtcactgagactctcctgtgcagcctctggaatcaccgtcagtagcaactacatgagctgggtccgccaggctccagggaaggggctggagtgggtctcacttatttatagtggtggtagcacatactacgcagactccgtgaagggcagattcaccatctccagagacaattccaagaacacgctgtatcttcaaatgaacagcctgagagtcgaggacacggctgtgtattactgtgcgagagatcacggtatggcagcagcggggtataattactggggccagggaaccctggtcaccgtctcctca

SEQ ID NO: 366 - protein, 119 aa, Artificial Sequence
  Synthetic
EVQLVESGGGLVQPGGSLRLSCAASGITVSSNYMSWVRQAPGKGLEWVSLIYSGGSTYYADSVKGRFTISRDNSKNTLYLQMNSLRVEDTAVYYCARDHGMAAAGYNYWGQGTLVTVSS

SEQ ID NO: 367 - DNA, 24 bp, Artificial Sequence
  Synthetic
ggaatcaccgtcagtagcaactac

SEQ ID NO: 368 - DNA, 21 bp, Artificial Sequence
  Synthetic
atttatagtggtggtagcaca

SEQ ID NO: 369 - DNA, 39 bp, Artificial Sequence
  Synthetic
gcgagagatcacggtatggcagcagcggggtataattac

SEQ ID NO: 370 - protein, 13 aa, Artificial Sequence
  Synthetic
ARDHGMAAAGYNY

SEQ ID NO: 371 - DNA, 321 bp, Artificial Sequence
  Synthetic
gacatccagatgacccagtctccatcctccctgtctgcgtctgtaggagacagagtcaccatcacttgccaggcgagtcaggacattaacaaatatttaaattggtatcagcagaaaccagggaaagcccctaagctcctgatctacgatgcatccaatttggaaacaggggtcccatcaaggttcagtggaagtggatctgggacagattttactttcaccatcaacagcctgcagcctgaagattttgcaacatatttctgtcaacagtatgataatctccctccagcgttcggccaagggaccaaggtggaaatcaaa

SEQ ID NO: 372 - protein, 107 aa, Artificial Sequence
  Synthetic
DIQMTQSPSSLSASVGDRVTITCQASQDINKYLNWYQQKPGKAPKLLIYDASNLETGVPSRFSGSGSGTDFTFTINSLQPEDFATYFCQQYDNLPPAFGQGTKVEIK

SEQ ID NO: 373 - DNA, 18 bp, Artificial Sequence
  Synthetic
caggacattaacaaatat

SEQ ID NO: 374 - DNA, 27 bp, Artificial Sequence
  Synthetic
caacagtatgataatctccctccagcg

SEQ ID NO: 375 - protein, 9 aa, Artificial Sequence
  Synthetic
QQYDNLPPA

SEQ ID NO: 376 - DNA, 1350 bp, Artificial Sequence
  Synthetic
gaggtgcagctggtggagtctgggggaggcttggtccagcctggggggtcactgagactctcctgtgcagcctctggaatcaccgtcagtagcaactacatgagctgggtccgccaggctccagggaaggggctggagtgggtctcacttatttatagtggtggtagcacatactacgcagactccgtgaagggcagattcaccatctccagagacaattccaagaacacgctgtatcttcaaatgaacagcctgagagtcgaggacacggctgtgtattactgtgcgagagatcacggtatggcagcagcggggtataattactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 377 - protein, 449 aa, Artificial Sequence
  Synthetic
EVQLVESGGGLVQPGGSLRLSCAASGITVSSNYMSWVRQAPGKGLEWVSLIYSGGSTYYADSVKGRFTISRDNSKNTLYLQMNSLRVEDTAVYYCARDHGMAAAGYNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 378 - DNA, 645 bp, Artificial Sequence
  Synthetic
gacatccagatgacccagtctccatcctccctgtctgcgtctgtaggagacagagtcaccatcacttgccaggcgagtcaggacattaacaaatatttaaattggtatcagcagaaaccagggaaagcccctaagctcctgatctacgatgcatccaatttggaaacaggggtcccatcaaggttcagtggaagtggatctgggacagattttactttcaccatcaacagcctgcagcctgaagattttgcaacatatttctgtcaacagtatgataatctccctccagcgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 379 - protein, 214 aa, Artificial Sequence
  Synthetic
DIQMTQSPSSLSASVGDRVTITCQASQDINKYLNWYQQKPGKAPKLLIYDASNLETGVPSRFSGSGSGTDFTFTINSLQPEDFATYFCQQYDNLPPAFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 380 - DNA, 345 bp, Artificial Sequence
  Synthetic
gaggtgcagctggtggagtctgggggaggcttggtccagcctggggggtccctgagagtctcctgtgcagcctctggattcaccgtcagtaggaactacatgagttgggtccgccaggctccagggaaggggctggagtgggtctcagttatttatagcggtggtagcacattctacgcagactccgtgaagggcagattcaccatctccagagacaattccaagaacacgctgtatcttcaaatgaacagcctgagagccgaggacacggctatatattactgtgcgagatacattcctaggttcgacccctggggccagggaaccctggtcaccgtctcctca

SEQ ID NO: 381 - protein, 115 aa, Artificial Sequence
  Synthetic
EVQLVESGGGLVQPGGSLRVSCAASGFTVSRNYMSWVRQAPGKGLEWVSVIYSGGSTFYADSVKGRFTISRDNSKNTLYLQMNSLRAEDTAIYYCARYIPRFDPWGQGTLVTVSS

SEQ ID NO: 382 - DNA, 24 bp, Artificial Sequence
  Synthetic
ggattcaccgtcagtaggaactac

SEQ ID NO: 383 - protein, 8 aa, Artificial Sequence
  Synthetic
GFTVSRNY

SEQ ID NO: 384 - DNA, 27 bp, Artificial Sequence
  Synthetic
gcgagatacattcctaggttcgacccc

SEQ ID NO: 385 - protein, 9 aa, Artificial Sequence
  Synthetic
ARYIPRFDP

SEQ ID NO: 386 - DNA, 321 bp, Artificial Sequence
  Synthetic
gacatccagatgacccagtctccatcctccctgtctgcatctgtaggagacagagtcaccatcacttgccaggcgagtcaggacattagcaactatttaaattggtttcagcagaaaccagggagagcccctaagctcctcatctacgatgcatccaatttggaaacaggggtcccatcaaggttcagtggaagtggatctgggacagattttactttcaccatcagcagcctgcagcctgaagatattgcaacatattactgtcaacagtatgataatctcccgatcaccttcggccaagggacacgactggagattaaa

SEQ ID NO: 387 - protein, 107 aa, Artificial Sequence
  Synthetic
DIQMTQSPSSLSASVGDRVTITCQASQDISNYLNWFQQKPGRAPKLLIYDASNLETGVPSRFSGSGSGTDFTFTISSLQPEDIATYYCQQYDNLPITFGQGTRLEIK

SEQ ID NO: 388 - DNA, 18 bp, Artificial Sequence
  Synthetic
caggacattagcaactat

SEQ ID NO: 389 - protein, 6 aa, Artificial Sequence
  Synthetic
QDISNY

SEQ ID NO: 390 - DNA, 27 bp, Artificial Sequence
  Synthetic
caacagtatgataatctcccgatcacc

SEQ ID NO: 391 - DNA, 1338 bp, Artificial Sequence
  Synthetic
gaggtgcagctggtggagtctgggggaggcttggtccagcctggggggtccctgagagtctcctgtgcagcctctggattcaccgtcagtaggaactacatgagttgggtccgccaggctccagggaaggggctggagtgggtctcagttatttatagcggtggtagcacattctacgcagactccgtgaagggcagattcaccatctccagagacaattccaagaacacgctgtatcttcaaatgaacagcctgagagccgaggacacggctatatattactgtgcgagatacattcctaggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 392 - protein, 445 aa, Artificial Sequence
  Synthetic
EVQLVESGGGLVQPGGSLRVSCAASGFTVSRNYMSWVRQAPGKGLEWVSVIYSGGSTFYADSVKGRFTISRDNSKNTLYLQMNSLRAEDTAIYYCARYIPRFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 393 - DNA, 645 bp, Artificial Sequence
  Synthetic
gacatccagatgacccagtctccatcctccctgtctgcatctgtaggagacagagtcaccatcacttgccaggcgagtcaggacattagcaactatttaaattggtttcagcagaaaccagggagagcccctaagctcctcatctacgatgcatccaatttggaaacaggggtcccatcaaggttcagtggaagtggatctgggacagattttactttcaccatcagcagcctgcagcctgaagatattgcaacatattactgtcaacagtatgataatctcccgatcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 394 - protein, 214 aa, Artificial Sequence
  Synthetic
DIQMTQSPSSLSASVGDRVTITCQASQDISNYLNWFQQKPGRAPKLLIYDASNLETGVPSRFSGSGSGTDFTFTISSLQPEDIATYYCQQYDNLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 395 - DNA, 351 bp, Artificial Sequence
  Synthetic
gaggtgcagctggtggagtctgggggaggcttggtccagcctggggggtccctgagactctcctgtgcagcctccggactcaccgtcagtagcaactacatgagctgggtccgccaggctccagggaaggggctggagtgggtctcagttatttatagcggtggtagcacattctacgcagactccgtgaagggccgattcaccatctccagagacaattccaagaacacgctgtatcttcaaatgaacagcctgagagctgaggacacggctgtgtattactgtgcgagagatcttatcaaatacggtatggacgtctggggccaagggaccacggtcaccgtctcctca

SEQ ID NO: 396 - protein, 117 aa, Artificial Sequence
  Synthetic
EVQLVESGGGLVQPGGSLRLSCAASGLTVSSNYMSWVRQAPGKGLEWVSVIYSGGSTFYADSVKGRFTISRDNSKNTLYLQMNSLRAEDTAVYYCARDLIKYGMDVWGQGTTVTVSS

SEQ ID NO: 397 - DNA, 24 bp, Artificial Sequence
  Synthetic
ggactcaccgtcagtagcaactac

SEQ ID NO: 398 - DNA, 33 bp, Artificial Sequence
  Synthetic
gcgagagatcttatcaaatacggtatggacgtc

SEQ ID NO: 399 - protein, 11 aa, Artificial Sequence
  Synthetic
ARDLIKYGMDV

SEQ ID NO: 400 - DNA, 321 bp, Artificial Sequence
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctccccatttcggccctgggaccaaagtggatatcaaa

SEQ ID NO: 401 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPPHFGPGTKVDIK

SEQ ID NO: 402 - DNA, 27 bp, Artificial Sequence
  Synthetic
caacagtatgataatctccctccccat

SEQ ID NO: 403 - protein, 9 aa, Artificial Sequence
  Synthetic
QQYDNLPPH

SEQ ID NO: 404 - DNA, 1344 bp, Artificial Sequence
  Synthetic
gaggtgcagctggtggagtctgggggaggcttggtccagcctggggggtccctgagactctcctgtgcagcctccggactcaccgtcagtagcaactacatgagctgggtccgccaggctccagggaaggggctggagtgggtctcagttatttatagcggtggtagcacattctacgcagactccgtgaagggccgattcaccatctccagagacaattccaagaacacgctgtatcttcaaatgaacagcctgagagctgaggacacggctgtgtattactgtgcgagagatcttatcaaatacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 405 - protein, 447 aa, Artificial Sequence
  Synthetic
EVQLVESGGGLVQPGGSLRLSCAASGLTVSSNYMSWVRQAPGKGLEWVSVIYSGGSTFYADSVKGRFTISRDNSKNTLYLQMNSLRAEDTAVYYCARDLIKYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 406 - DNA, 645 bp, Artificial Sequence
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctccccatttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 407 - protein, 214 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPPHFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 408 - DNA, 351 bp, Artificial Sequence
  Synthetic
gaggtgcagctggtggagtctggaggaggcttggtccagcctggggggtccctgagactctcctgtgcagcctctggggtcaccgtcagtagcaactatatgagctgggtccgccaggctccagggaaggggctggagtgggtctcagttatttatagcggtggtagtacattctacgcagactccgtgaagggccgatttaccatctccagagacaactccaagaacacgctgtttcttcaaatgaacagcctgagaattgaggacacggccgtgtattattgtgcgagagatttaggtccttacggtatggacgtctggggccaagggaccacggtcaccgtctcctca

SEQ ID NO: 409 - protein, 117 aa, Artificial Sequence
  Synthetic
EVQLVESGGGLVQPGGSLRLSCAASGVTVSSNYMSWVRQAPGKGLEWVSVIYSGGSTFYADSVKGRFTISRDNSKNTLFLQMNSLRIEDTAVYYCARDLGPYGMDVWGQGTTVTVSS

SEQ ID NO: 410 - DNA, 24 bp, Artificial Sequence
  Synthetic
ggggtcaccgtcagtagcaactat

SEQ ID NO: 411 - protein, 8 aa, Artificial Sequence
  Synthetic
GVTVSSNY

SEQ ID NO: 412 - DNA, 21 bp, Artificial Sequence
  Synthetic
atttatagcggtggtagtaca

SEQ ID NO: 413 - DNA, 33 bp, Artificial Sequence
  Synthetic
gcgagagatttaggtccttacggtatggacgtc

SEQ ID NO: 414 - protein, 11 aa, Artificial Sequence
  Synthetic
ARDLGPYGMDV

SEQ ID NO: 415 - DNA, 324 bp, Artificial Sequence
  Synthetic
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacacaattcattctcacaatcagcagcctgcagcctgaagattttgcaacttattactgtcaacagcttaatagttaccccggattcactttcggccctgggaccaaagtggatatcaaa

SEQ ID NO: 416 - protein, 108 aa, Artificial Sequence
  Synthetic
DIQLTQSPSFLSASVGDRVTITCRASQGISSYLAWYQQKPGKAPKLLIYAASTLQSGVPSRFSGSGSGTQFILTISSLQPEDFATYYCQQLNSYPGFTFGPGTKVDIK

SEQ ID NO: 417 - DNA, 30 bp, Artificial Sequence
  Synthetic
caacagcttaatagttaccccggattcact

SEQ ID NO: 418 - protein, 10 aa, Artificial Sequence
  Synthetic
QQLNSYPGFT

SEQ ID NO: 419 - DNA, 1344 bp, Artificial Sequence
  Synthetic
gaggtgcagctggtggagtctggaggaggcttggtccagcctggggggtccctgagactctcctgtgcagcctctggggtcaccgtcagtagcaactatatgagctgggtccgccaggctccagggaaggggctggagtgggtctcagttatttatagcggtggtagtacattctacgcagactccgtgaagggccgatttaccatctccagagacaactccaagaacacgctgtttcttcaaatgaacagcctgagaattgaggacacggccgtgtattattgtgcgagagatttaggtccttacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 420 - protein, 447 aa, Artificial Sequence
  Synthetic
EVQLVESGGGLVQPGGSLRLSCAASGVTVSSNYMSWVRQAPGKGLEWVSVIYSGGSTFYADSVKGRFTISRDNSKNTLFLQMNSLRIEDTAVYYCARDLGPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 421 - DNA, 648 bp, Artificial Sequence
  Synthetic
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacacaattcattctcacaatcagcagcctgcagcctgaagattttgcaacttattactgtcaacagcttaatagttaccccggattcactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 422 - protein, 215 aa, Artificial Sequence
  Synthetic
DIQLTQSPSFLSASVGDRVTITCRASQGISSYLAWYQQKPGKAPKLLIYAASTLQSGVPSRFSGSGSGTQFILTISSLQPEDFATYYCQQLNSYPGFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 423 - DNA, 1338 bp, Artificial Sequence
  Synthetic
gaggtgcagctggtggagtctgggggaggcttggtccagcctggggggtcactgagactctcctgtgcagcctctggaatcaccgtcagtagcaactacatgagctgggtccgccaggctccagggaaggggctggagtgggtctcacttatttatagtggtggtagcacatactacgcagactccgtgaagggcagattcaccatctccagagacaattccaagaacacgctgtatcttcaaatgaacagcctgagagtcgaggacacggctgtgtattactgtgcgagagatcacggtatggcagcagcggggtataattactggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 424 - protein, 445 aa, Artificial Sequence
  Synthetic
EVQLVESGGGLVQPGGSLRLSCAASGITVSSNYMSWVRQAPGKGLEWVSLIYSGGSTYYADSVKGRFTISRDNSKNTLYLQMNSLRVEDTAVYYCARDHGMAAAGYNYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 425 - DNA, 1326 bp, Artificial Sequence
  Synthetic
gaggtgcagctggtggagtctgggggaggcttggtccagcctggggggtccctgagagtctcctgtgcagcctctggattcaccgtcagtaggaactacatgagttgggtccgccaggctccagggaaggggctggagtgggtctcagttatttatagcggtggtagcacattctacgcagactccgtgaagggcagattcaccatctccagagacaattccaagaacacgctgtatcttcaaatgaacagcctgagagccgaggacacggctatatattactgtgcgagatacattcctaggttcgacccctggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 426 - protein, 441 aa, Artificial Sequence
  Synthetic
EVQLVESGGGLVQPGGSLRVSCAASGFTVSRNYMSWVRQAPGKGLEWVSVIYSGGSTFYADSVKGRFTISRDNSKNTLYLQMNSLRAEDTAIYYCARYIPRFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 427 - DNA, 1332 bp, Artificial Sequence
  Synthetic
gaggtgcagctggtggagtctgggggaggcttggtccagcctggggggtccctgagactctcctgtgcagcctccggactcaccgtcagtagcaactacatgagctgggtccgccaggctccagggaaggggctggagtgggtctcagttatttatagcggtggtagcacattctacgcagactccgtgaagggccgattcaccatctccagagacaattccaagaacacgctgtatcttcaaatgaacagcctgagagctgaggacacggctgtgtattactgtgcgagagatcttatcaaatacggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 428 - protein, 443 aa, Artificial Sequence
  Synthetic
EVQLVESGGGLVQPGGSLRLSCAASGLTVSSNYMSWVRQAPGKGLEWVSVIYSGGSTFYADSVKGRFTISRDNSKNTLYLQMNSLRAEDTAVYYCARDLIKYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 429 - DNA, 1332 bp, Artificial Sequence
  Synthetic
gaggtgcagctggtggagtctggaggaggcttggtccagcctggggggtccctgagactctcctgtgcagcctctggggtcaccgtcagtagcaactatatgagctgggtccgccaggctccagggaaggggctggagtgggtctcagttatttatagcggtggtagtacattctacgcagactccgtgaagggccgatttaccatctccagagacaactccaagaacacgctgtttcttcaaatgaacagcctgagaattgaggacacggccgtgtattattgtgcgagagatttaggtccttacggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 430 - protein, 443 aa, Artificial Sequence
  Synthetic
EVQLVESGGGLVQPGGSLRLSCAASGVTVSSNYMSWVRQAPGKGLEWVSVIYSGGSTFYADSVKGRFTISRDNSKNTLFLQMNSLRIEDTAVYYCARDLGPYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 431 - DNA, 354 bp, Artificial Sequence
  Synthetic
caggtgcagctgcaggagtcgggcccaggactggtgaagccttcggagaccctgtccctcacctgcactgtctctggtggctccatcaataattactactggatctggatccggcagcccccagggaagggactggagtggattgggtatatctatcacagtgggagcaccaactacaacccctccctcaagagtcgagtcaccatatcagtagacacgtccaagaaccaattctccctgaaggtgagctctgtgaccgctgcggacacggccgtgtattactgtgcgaatatggttcggggagtttatgaagatgactactggggccagggaaccctggtcaccgtctcctca

SEQ ID NO: 432 - protein, 118 aa, Artificial Sequence
  Synthetic
QVQLQESGPGLVKPSETLSLTCTVSGGSINNYYWIWIRQPPGKGLEWIGYIYHSGSTNYNPSLKSRVTISVDTSKNQFSLKVSSVTAADTAVYYCANMVRGVYEDDYWGQGTLVTVSS

SEQ ID NO: 433 - DNA, 24 bp, Artificial Sequence
  Synthetic
ggtggctccatcaataattactac

SEQ ID NO: 434 - protein, 8 aa, Artificial Sequence
  Synthetic
GGSINNYY

SEQ ID NO: 435 - DNA, 21 bp, Artificial Sequence
  Synthetic
atctatcacagtgggagcacc

SEQ ID NO: 436 - protein, 7 aa, Artificial Sequence
  Synthetic
IYHSGST

SEQ ID NO: 437 - DNA, 36 bp, Artificial Sequence
  Synthetic
gcgaatatggttcggggagtttatgaagatgactac

SEQ ID NO: 438 - protein, 12 aa, Artificial Sequence
  Synthetic
ANMVRGVYEDDY

SEQ ID NO: 439 - DNA, 321 bp, Artificial Sequence
  Synthetic
gacatccagatgacccagtctccatcctccctgtctgcatctgtaggagacagagtcaccatcacttgccgggcaagtcagagcattagcaactatttaaattggtatcagcagaaaccagggaaagcccctaagctcctgatctttgctgcctccagtttgcgaagtggggtcccatcaaggttcagtggcagtggatctgggacagatttcactctcaccatcagcagtctgcaccctgaagattttgcaacttactactgtcaacagaattacaatacccccctcactttcggccctgggaccaaagtggatatcaaa

SEQ ID NO: 440 - protein, 107 aa, Artificial Sequence
  Synthetic
DIQMTQSPSSLSASVGDRVTITCRASQSISNYLNWYQQKPGKAPKLLIFAASSLRSGVPSRFSGSGSGTDFTLTISSLHPEDFATYYCQQNYNTPLTFGPGTKVDIK

SEQ ID NO: 441 - DNA, 18 bp, Artificial Sequence
  Synthetic
cagagcattagcaactat

SEQ ID NO: 442 - protein, 6 aa, Artificial Sequence
  Synthetic
QSISNY

SEQ ID NO: 443 - DNA, 9 bp, Artificial Sequence
  Synthetic
gctgcctcc

SEQ ID NO: 444 - DNA, 27 bp, Artificial Sequence
  Synthetic
caacagaattacaatacccccctcact

SEQ ID NO: 445 - protein, 9 aa, Artificial Sequence
  Synthetic
QQNYNTPLT

SEQ ID NO: 446 - DNA, 1347 bp, Artificial Sequence
  Synthetic
caggtgcagctgcaggagtcgggcccaggactggtgaagccttcggagaccctgtccctcacctgcactgtctctggtggctccatcaataattactactggatctggatccggcagcccccagggaagggactggagtggattgggtatatctatcacagtgggagcaccaactacaacccctccctcaagagtcgagtcaccatatcagtagacacgtccaagaaccaattctccctgaaggtgagctctgtgaccgctgcggacacggccgtgtattactgtgcgaatatggttcggggagtttatgaagatgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 447 - protein, 448 aa, Artificial Sequence
  Synthetic
QVQLQESGPGLVKPSETLSLTCTVSGGSINNYYWIWIRQPPGKGLEWIGYIYHSGSTNYNPSLKSRVTISVDTSKNQFSLKVSSVTAADTAVYYCANMVRGVYEDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 448 - DNA, 645 bp, Artificial Sequence
  Synthetic
gacatccagatgacccagtctccatcctccctgtctgcatctgtaggagacagagtcaccatcacttgccgggcaagtcagagcattagcaactatttaaattggtatcagcagaaaccagggaaagcccctaagctcctgatctttgctgcctccagtttgcgaagtggggtcccatcaaggttcagtggcagtggatctgggacagatttcactctcaccatcagcagtctgcaccctgaagattttgcaacttactactgtcaacagaattacaatacccccctcactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 449 - protein, 214 aa, Artificial Sequence
  Synthetic
DIQMTQSPSSLSASVGDRVTITCRASQSISNYLNWYQQKPGKAPKLLIFAASSLRSGVPSRFSGSGSGTDFTLTISSLHPEDFATYYCQQNYNTPLTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 450 - DNA, 366 bp, Artificial Sequence
  Synthetic
gaggtgcagctggtggagtctggaggaggcttgatccagcctggggggtccctgagactctcctgtgcagcctctgtgttcaccgtcagttacaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagccctccccgggtggggtgggagcttcgagtactttgactactggggccagggaaccctggtcaccgtctcctca

SEQ ID NO: 451 - protein, 122 aa, Artificial Sequence
  Synthetic
EVQLVESGGGLIQPGGSLRLSCAASVFTVSYNYMSWVRQAPGKGLEWVSVIYSGGSTYYADSVKGRFTISRDNSKNTLYLQMNSLRAEDTAVYYCARALPGWGGSFEYFDYWGQGTLVTVSS

SEQ ID NO: 452 - DNA, 24 bp, Artificial Sequence
  Synthetic
gtgttcaccgtcagttacaactac

SEQ ID NO: 453 - protein, 8 aa, Artificial Sequence
  Synthetic
VFTVSYNY

SEQ ID NO: 454 - DNA, 48 bp, Artificial Sequence
  Synthetic
gcgagagccctccccgggtggggtgggagcttcgagtactttgactac

SEQ ID NO: 455 - protein, 16 aa, Artificial Sequence
  Synthetic
ARALPGWGGSFEYFDY

SEQ ID NO: 456 - DNA, 321 bp, Artificial Sequence
  Synthetic
gacatccagatgacccagtctccttccaccctgtctgcatctgtaggagacagagtcaccatcacttgccgggccagtcagagtattagtagttggttggcctggtatcagcagaaaccagggaaagcccctaagctcctgatctataaggcatctagtttagaaagtggggtctcatcaaggttcagcggcagtggatctgggacagaattcactctcaccatcagcagcctgcagcctgatgattttgcaacttattactgccaacagtataatagttattctgtgacgttcggccaagggaccaaggtggaaatcaaa

SEQ ID NO: 457 - protein, 107 aa, Artificial Sequence
  Synthetic
DIQMTQSPSTLSASVGDRVTITCRASQSISSWLAWYQQKPGKAPKLLIYKASSLESGVSSRFSGSGSGTEFTLTISSLQPDDFATYYCQQYNSYSVTFGQGTKVEIK

SEQ ID NO: 458 - DNA, 18 bp, Artificial Sequence
  Synthetic
cagagtattagtagttgg

SEQ ID NO: 459 - protein, 6 aa, Artificial Sequence
  Synthetic
QSISSW

SEQ ID NO: 460 - DNA, 9 bp, Artificial Sequence
  Synthetic
aaggcatct

SEQ ID NO: 461 - DNA, 27 bp, Artificial Sequence
  Synthetic
caacagtataatagttattctgtgacg

SEQ ID NO: 462 - protein, 9 aa, Artificial Sequence
  Synthetic
QQYNSYSVT

SEQ ID NO: 463 - DNA, 1359 bp, Artificial Sequence
  Synthetic
gaggtgcagctggtggagtctggaggaggcttgatccagcctggggggtccctgagactctcctgtgcagcctctgtgttcaccgtcagttacaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagccctccccgggtggggtgggagcttcgagtactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 464 - protein, 452 aa, Artificial Sequence
  Synthetic
EVQLVESGGGLIQPGGSLRLSCAASVFTVSYNYMSWVRQAPGKGLEWVSVIYSGGSTYYADSVKGRFTISRDNSKNTLYLQMNSLRAEDTAVYYCARALPGWGGSFEYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 465 - DNA, 645 bp, Artificial Sequence
  Synthetic
gacatccagatgacccagtctccttccaccctgtctgcatctgtaggagacagagtcaccatcacttgccgggccagtcagagtattagtagttggttggcctggtatcagcagaaaccagggaaagcccctaagctcctgatctataaggcatctagtttagaaagtggggtctcatcaaggttcagcggcagtggatctgggacagaattcactctcaccatcagcagcctgcagcctgatgattttgcaacttattactgccaacagtataatagttattctgtgacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 466 - protein, 214 aa, Artificial Sequence
  Synthetic
DIQMTQSPSTLSASVGDRVTITCRASQSISSWLAWYQQKPGKAPKLLIYKASSLESGVSSRFSGSGSGTEFTLTISSLQPDDFATYYCQQYNSYSVTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 467 - DNA, 363 bp, Artificial Sequence
  Synthetic
gaggtgcagctggtggagtctgggggaggcttggtccagcctggggggtccctgagactctcctgtgcagcctctggactcaccgtcagtagcaactacatgagctgggtccgccaggctccagggaaggggctggagtgggtctcagttatttatagcggtggtagtacattctacgcagactccgtgaagggccgattcaccatctccagagacaattccaagaacacgttgtatcttcagatgaacagcctgagacctgaggacacggctgtgtattactgtgcgagagagggccgtatagcagcaactggctacggtatggacgtctggggccaagggaccacggtcaccgtctcctca

SEQ ID NO: 468 - protein, 121 aa, Artificial Sequence
  Synthetic
EVQLVESGGGLVQPGGSLRLSCAASGLTVSSNYMSWVRQAPGKGLEWVSVIYSGGSTFYADSVKGRFTISRDNSKNTLYLQMNSLRPEDTAVYYCAREGRIAATGYGMDVWGQGTTVTVSS

SEQ ID NO: 469 - DNA, 45 bp, Artificial Sequence
  Synthetic
gcgagagagggccgtatagcagcaactggctacggtatggacgtc

SEQ ID NO: 470 - protein, 15 aa, Artificial Sequence
  Synthetic
AREGRIAATGYGMDV

SEQ ID NO: 471 - DNA, 321 bp, Artificial Sequence
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttgggaacaggggtcccatcaaggttcagtggaagtagatctgggacagattttactttcaccatcagcagcctgcagcctgaagatattgcgacatattactgtcatcagtatgataatctccctcaaactttcggccctgggaccaaagtggatatcaaa

SEQ ID NO: 472 - protein, 107 aa, Artificial Sequence
  Synthetic
DIQMTQSPSSLSASVGDRVTITCQASQDISNYLNWYQQKPGKAPKLLIYDASNLGTGVPSRFSGSRSGTDFTFTISSLQPEDIATYYCHQYDNLPQTFGPGTKVDIK

SEQ ID NO: 473 - DNA, 27 bp, Artificial Sequence
  Synthetic
catcagtatgataatctccctcaaact

SEQ ID NO: 474 - protein, 9 aa, Artificial Sequence
  Synthetic
HQYDNLPQT

SEQ ID NO: 475 - DNA, 1356 bp, Artificial Sequence
  Synthetic
gaggtgcagctggtggagtctgggggaggcttggtccagcctggggggtccctgagactctcctgtgcagcctctggactcaccgtcagtagcaactacatgagctgggtccgccaggctccagggaaggggctggagtgggtctcagttatttatagcggtggtagtacattctacgcagactccgtgaagggccgattcaccatctccagagacaattccaagaacacgttgtatcttcagatgaacagcctgagacctgaggacacggctgtgtattactgtgcgagagagggccgtatagcagcaactggctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 476 - protein, 451 aa, Artificial Sequence
  Synthetic
EVQLVESGGGLVQPGGSLRLSCAASGLTVSSNYMSWVRQAPGKGLEWVSVIYSGGSTFYADSVKGRFTISRDNSKNTLYLQMNSLRPEDTAVYYCAREGRIAATGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 477 - DNA, 645 bp, Artificial Sequence
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttgggaacaggggtcccatcaaggttcagtggaagtagatctgggacagattttactttcaccatcagcagcctgcagcctgaagatattgcgacatattactgtcatcagtatgataatctccctcaaactttcggccctgggaccaaagtggatatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 478 - protein, 214 aa, Artificial Sequence
  Synthetic
DIQMTQSPSSLSASVGDRVTITCQASQDISNYLNWYQQKPGKAPKLLIYDASNLGTGVPSRFSGSRSGTDFTFTISSLQPEDIATYYCHQYDNLPQTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 479 - DNA, 342 bp, Artificial Sequence
  Synthetic
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatcccggtggtagtacattctacgcagactccgtgaagggcagattcaccatctccagagacaattccaagaacacgctgtatcttcaaatgaacagcctgagagccgaggacacggctgtgtattactgtgcgagagatcaacgcgattttgcctggggccagggaaccctggtcaccgtctcctca

SEQ ID NO: 480 - protein, 114 aa, Artificial Sequence
  Synthetic
EVQLVESGGGLVQPGGSLRLSCAASGFTVSSNYMSWVRQAPGKGLEWVSVIYPGGSTFYADSVKGRFTISRDNSKNTLYLQMNSLRAEDTAVYYCARDQRDFAWGQGTLVTVSS

SEQ ID NO: 481 - DNA, 24 bp, Artificial Sequence
  Synthetic
ggattcaccgtcagtagcaactac

SEQ ID NO: 482 - DNA, 21 bp, Artificial Sequence
  Synthetic
atttatcccggtggtagtaca

SEQ ID NO: 483 - protein, 7 aa, Artificial Sequence
  Synthetic
IYPGGST

SEQ ID NO: 484 - DNA, 24 bp, Artificial Sequence
  Synthetic
gcgagagatcaacgcgattttgcc

SEQ ID NO: 485 - protein, 8 aa, Artificial Sequence
  Synthetic
ARDQRDFA

SEQ ID NO: 486 - DNA, 321 bp, Artificial Sequence
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcggcctgcagcctgaagatattgcaacatattactgtcaacagtatgataatctccctccgaccttcggccaagggacacgactggagattaaa

SEQ ID NO: 487 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISGLQPEDIATYYCQQYDNLPPTFGQGTRLEIK

SEQ ID NO: 488 - DNA, 27 bp, Artificial Sequence
  Synthetic
caacagtatgataatctccctccgacc

SEQ ID NO: 489 - protein, 9 aa, Artificial Sequence
  Synthetic
QQYDNLPPT

SEQ ID NO: 490 - DNA, 1335 bp, Artificial Sequence
  Synthetic
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatcccggtggtagtacattctacgcagactccgtgaagggcagattcaccatctccagagacaattccaagaacacgctgtatcttcaaatgaacagcctgagagccgaggacacggctgtgtattactgtgcgagagatcaacgcgattttgcctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 491 - protein, 444 aa, Artificial Sequence
  Synthetic
EVQLVESGGGLVQPGGSLRLSCAASGFTVSSNYMSWVRQAPGKGLEWVSVIYPGGSTFYADSVKGRFTISRDNSKNTLYLQMNSLRAEDTAVYYCARDQRDFAWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 492 - DNA, 645 bp, Artificial Sequence
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcggcctgcagcctgaagatattgcaacatattactgtcaacagtatgataatctccctccgaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 493 - protein, 214 aa, Artificial Sequence
  Synthetic
DIQMTQSPSSLSASVGDRVTITCQASQDISNYLNWYQQKPGKAPKLLIYDASNLETGVPSRFSGSGSGTDFTFTISGLQPEDIATYYCQQYDNLPPTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 494 - DNA, 381 bp, Artificial Sequence
  Synthetic
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagacggccggactattactatggttcggggagttattgatgatgcttttgatatctggggccaagggacaatggtcaccgtctcttca

SEQ ID NO: 495 - protein, 127 aa, Artificial Sequence
  Synthetic
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGRTITMVRGVIDDAFDIWGQGTMVTVSS

SEQ ID NO: 496 - DNA, 24 bp, Artificial Sequence
  Synthetic
ggattcaccttcagtagctatgct

SEQ ID NO: 497 - protein, 8 aa, Artificial Sequence
  Synthetic
GFTFSSYA

SEQ ID NO: 498 - DNA, 24 bp, Artificial Sequence
  Synthetic
atatcatatgatggaagtaataaa

SEQ ID NO: 499 - protein, 8 aa, Artificial Sequence
  Synthetic
ISYDGSNK

SEQ ID NO: 500 - DNA, 60 bp, Artificial Sequence
  Synthetic
gcgagagacggccggactattactatggttcggggagttattgatgatgcttttgatatc

SEQ ID NO: 501 - protein, 20 aa, Artificial Sequence
  Synthetic
ARDGRTITMVRGVIDDAFDI

SEQ ID NO: 502 - DNA, 321 bp, Artificial Sequence
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccccctcaccttcggccaagggacacgactggagattaaa

SEQ ID NO: 503 - protein, 107 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGQGTRLEIK

SEQ ID NO: 504 - DNA, 27 bp, Artificial Sequence
  Synthetic
caacagtatgataatctccccctcacc

SEQ ID NO: 505 - DNA, 1374 bp, Artificial Sequence
  Synthetic
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagacggccggactattactatggttcggggagttattgatgatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 506 - protein, 457 aa, Artificial Sequence
  Synthetic
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGRTITMVRGVIDDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 507 - DNA, 645 bp, Artificial Sequence
  Synthetic
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccccctcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 508 - protein, 214 aa, Artificial Sequence
  Synthetic
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 509 - DNA, 360 bp, Artificial Sequence
  Synthetic
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagtacatactacgcagactccgtgaagggccgattcaccatctccagagacaattccaagaacacgctgtatcttcaaatgaacagactgagagctgacgacacggctgtctattactgtgtgagagatccggtggggcgctactactacggtatggacgtctggggccaagggaccacggtcaccgtctcctca

SEQ ID NO: 510 - protein, 120 aa, Artificial Sequence
  Synthetic
EVQLVESGGGLVQPGGSLRLSCAASGFTVSSNYMSWVRQAPGKGLEWVSVIYSGGSTYYADSVKGRFTISRDNSKNTLYLQMNRLRADDTAVYYCVRDPVGRYYYGMDVWGQGTTVTVSS

SEQ ID NO: 511 - DNA, 42 bp, Artificial Sequence
  Synthetic
gtgagagatccggtggggcgctactactacggtatggacgtc

SEQ ID NO: 512 - protein, 14 aa, Artificial Sequence
  Synthetic
VRDPVGRYYYGMDV

SEQ ID NO: 513 - DNA, 321 bp, Artificial Sequence
  Synthetic
gacatccagatgacccagtctccatcctccctgtctgcatctgtaggagacagagtcaccatcacttgccaggcgagtcaggacattaacaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattattgtcaacagtatgataatctccctcgcactttcggcggagggaccaaggtggagatcaaa

SEQ ID NO: 514 - protein, 107 aa, Artificial Sequence
  Synthetic
DIQMTQSPSSLSASVGDRVTITCQASQDINNYLNWYQQKPGKAPKLLIYDASNLETGVPSRFSGSGSGTDFTFTISSLQPEDIATYYCQQYDNLPRTFGGGTKVEIK

SEQ ID NO: 515 - DNA, 18 bp, Artificial Sequence
  Synthetic
caggacattaacaactat

SEQ ID NO: 516 - protein, 6 aa, Artificial Sequence
  Synthetic
QDINNY

SEQ ID NO: 517 - DNA, 27 bp, Artificial Sequence
  Synthetic
caacagtatgataatctccctcgcact

SEQ ID NO: 518 - protein, 9 aa, Artificial Sequence
  Synthetic
QQYDNLPRT

SEQ ID NO: 519 - DNA, 1353 bp, Artificial Sequence
  Synthetic
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagtacatactacgcagactccgtgaagggccgattcaccatctccagagacaattccaagaacacgctgtatcttcaaatgaacagactgagagctgacgacacggctgtctattactgtgtgagagatccggtggggcgctactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 520 - protein, 450 aa, Artificial Sequence
  Synthetic
EVQLVESGGGLVQPGGSLRLSCAASGFTVSSNYMSWVRQAPGKGLEWVSVIYSGGSTYYADSVKGRFTISRDNSKNTLYLQMNRLRADDTAVYYCVRDPVGRYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 521 - DNA, 645 bp, Artificial Sequence
  Synthetic
gacatccagatgacccagtctccatcctccctgtctgcatctgtaggagacagagtcaccatcacttgccaggcgagtcaggacattaacaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattattgtcaacagtatgataatctccctcgcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 522 - protein, 214 aa, Artificial Sequence
  Synthetic
DIQMTQSPSSLSASVGDRVTITCQASQDINNYLNWYQQKPGKAPKLLIYDASNLETGVPSRFSGSGSGTDFTFTISSLQPEDIATYYCQQYDNLPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 523 - DNA, 351 bp, Artificial Sequence
  Synthetic
gaggtgcagctggtggagtctggaggaggcttgatccagcctggggggtccctgagactctcctgtgcagcctctggggtcaccgtcagtagcaactacatgagctgggtccgccaggctccagggaaggggctggagtgggtctcagtcatttatagcggcggtagcacattctactcagactccgtgaagggccgattcagcatctccagagacaattccaagaacacactgtatcttcaaatgaacagcctgagagccgaggacacggccgtgtattactgtgcgagagacctctactactacggtatggacgtctggggccaagggaccacggtcaccgtctcctca

SEQ ID NO: 524 - protein, 117 aa, Artificial Sequence
  Synthetic
EVQLVESGGGLIQPGGSLRLSCAASGVTVSSNYMSWVRQAPGKGLEWVSVIYSGGSTFYSDSVKGRFSISRDNSKNTLYLQMNSLRAEDTAVYYCARDLYYYGMDVWGQGTTVTVSS

SEQ ID NO: 525 - DNA, 24 bp, Artificial Sequence
  Synthetic
ggggtcaccgtcagtagcaactac

SEQ ID NO: 526 - DNA, 21 bp, Artificial Sequence
  Synthetic
atttatagcggcggtagcaca

SEQ ID NO: 527 - DNA, 33 bp, Artificial Sequence
  Synthetic
gcgagagacctctactactacggtatggacgtc

SEQ ID NO: 528 - protein, 11 aa, Artificial Sequence
  Synthetic
ARDLYYYGMDV

SEQ ID NO: 529 - DNA, 324 bp, Artificial Sequence
  Synthetic
gacatccagttgacccagtctccatccttcctgtctgcatctgtaggagacagagtcaccatcacttgccgggccagtcagggcattagcacttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttgatagttaccctgggctcactttcggcggagggaccaaggtggagatcaaa

SEQ ID NO: 530 - protein, 108 aa, Artificial Sequence
  Synthetic
DIQLTQSPSFLSASVGDRVTITCRASQGISTYLAWYQQKPGKAPKLLIYAASTLQSGVPSRFSGSGSGTEFTLTISSLQPEDFATYYCQQLDSYPGLTFGGGTKVEIK

SEQ ID NO: 531 - DNA, 18 bp, Artificial Sequence
  Synthetic
cagggcattagcacttat

SEQ ID NO: 532 - protein, 6 aa, Artificial Sequence
  Synthetic
QGISTY

SEQ ID NO: 533 - DNA, 30 bp, Artificial Sequence
  Synthetic
caacagcttgatagttaccctgggctcact

SEQ ID NO: 534 - protein, 10 aa, Artificial Sequence
  Synthetic
QQLDSYPGLT

SEQ ID NO: 535 - DNA, 1344 bp, Artificial Sequence
  Synthetic
gaggtgcagctggtggagtctggaggaggcttgatccagcctggggggtccctgagactctcctgtgcagcctctggggtcaccgtcagtagcaactacatgagctgggtccgccaggctccagggaaggggctggagtgggtctcagtcatttatagcggcggtagcacattctactcagactccgtgaagggccgattcagcatctccagagacaattccaagaacacactgtatcttcaaatgaacagcctgagagccgaggacacggccgtgtattactgtgcgagagacctctactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 536 - protein, 447 aa, Artificial Sequence
  Synthetic
EVQLVESGGGLIQPGGSLRLSCAASGVTVSSNYMSWVRQAPGKGLEWVSVIYSGGSTFYSDSVKGRFSISRDNSKNTLYLQMNSLRAEDTAVYYCARDLYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 537 - DNA, 648 bp, Artificial Sequence
  Synthetic
gacatccagttgacccagtctccatccttcctgtctgcatctgtaggagacagagtcaccatcacttgccgggccagtcagggcattagcacttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttgatagttaccctgggctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 538 - protein, 215 aa, Artificial Sequence
  Synthetic
DIQLTQSPSFLSASVGDRVTITCRASQGISTYLAWYQQKPGKAPKLLIYAASTLQSGVPSRFSGSGSGTEFTLTISSLQPEDFATYYCQQLDSYPGLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 539 - DNA, 1335 bp, Artificial Sequence
  Synthetic
caggtgcagctgcaggagtcgggcccaggactggtgaagccttcggagaccctgtccctcacctgcactgtctctggtggctccatcaataattactactggatctggatccggcagcccccagggaagggactggagtggattgggtatatctatcacagtgggagcaccaactacaacccctccctcaagagtcgagtcaccatatcagtagacacgtccaagaaccaattctccctgaaggtgagctctgtgaccgctgcggacacggccgtgtattactgtgcgaatatggttcggggagtttatgaagatgactactggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 540 - protein, 444 aa, Artificial Sequence
  Synthetic
QVQLQESGPGLVKPSETLSLTCTVSGGSINNYYWIWIRQPPGKGLEWIGYIYHSGSTNYNPSLKSRVTISVDTSKNQFSLKVSSVTAADTAVYYCANMVRGVYEDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 541 - DNA, 1347 bp, Artificial Sequence
  Synthetic
gaggtgcagctggtggagtctggaggaggcttgatccagcctggggggtccctgagactctcctgtgcagcctctgtgttcaccgtcagttacaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagccctccccgggtggggtgggagcttcgagtactttgactactggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 542 - protein, 448 aa, Artificial Sequence
  Synthetic
EVQLVESGGGLIQPGGSLRLSCAASVFTVSYNYMSWVRQAPGKGLEWVSVIYSGGSTYYADSVKGRFTISRDNSKNTLYLQMNSLRAEDTAVYYCARALPGWGGSFEYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 543 - DNA, 1344 bp, Artificial Sequence
  Synthetic
gaggtgcagctggtggagtctgggggaggcttggtccagcctggggggtccctgagactctcctgtgcagcctctggactcaccgtcagtagcaactacatgagctgggtccgccaggctccagggaaggggctggagtgggtctcagttatttatagcggtggtagtacattctacgcagactccgtgaagggccgattcaccatctccagagacaattccaagaacacgttgtatcttcagatgaacagcctgagacctgaggacacggctgtgtattactgtgcgagagagggccgtatagcagcaactggctacggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 544 - protein, 447 aa, Artificial Sequence
  Synthetic
EVQLVESGGGLVQPGGSLRLSCAASGLTVSSNYMSWVRQAPGKGLEWVSVIYSGGSTFYADSVKGRFTISRDNSKNTLYLQMNSLRPEDTAVYYCAREGRIAATGYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 545 - DNA, 1323 bp, Artificial Sequence
  Synthetic
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatcccggtggtagtacattctacgcagactccgtgaagggcagattcaccatctccagagacaattccaagaacacgctgtatcttcaaatgaacagcctgagagccgaggacacggctgtgtattactgtgcgagagatcaacgcgattttgcctggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 546 - protein, 440 aa, Artificial Sequence
  Synthetic
EVQLVESGGGLVQPGGSLRLSCAASGFTVSSNYMSWVRQAPGKGLEWVSVIYPGGSTFYADSVKGRFTISRDNSKNTLYLQMNSLRAEDTAVYYCARDQRDFAWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 547 - DNA, 369 bp, Artificial Sequence
  Synthetic
caggtgcagctggtgcagtctggggctgaggtgaagaagcctgggtcctcggtgaaggtctcctgcaaggcttctggaggcaccttcagcagctatgctatcacctgggtgcgacaggcccctggacaagggcttgagtggatgggaaggatcatccctatgtttggtatagcaaactacgcacagaagttccagggcagagtcacgattaccgcggacaaatccacgagcacagcctacatggaggtgagcagcctgagatctgaggacacggccgtgtattactgtgcgagaacaccgttttactatgatagtagtggttattaccttgactactggggccagggaaccctggtcaccgtctcctca

SEQ ID NO: 548 - protein, 123 aa, Artificial Sequence
  Synthetic
QVQLVQSGAEVKKPGSSVKVSCKASGGTFSSYAITWVRQAPGQGLEWMGRIIPMFGIANYAQKFQGRVTITADKSTSTAYMEVSSLRSEDTAVYYCARTPFYYDSSGYYLDYWGQGTLVTVSS

SEQ ID NO: 549 - DNA, 24 bp, Artificial Sequence
  Synthetic
ggaggcaccttcagcagctatgct

SEQ ID NO: 550 - protein, 8 aa, Artificial Sequence
  Synthetic
GGTFSSYA

SEQ ID NO: 551 - DNA, 24 bp, Artificial Sequence
  Synthetic
atcatccctatgtttggtatagca

SEQ ID NO: 552 - protein, 8 aa, Artificial Sequence
  Synthetic
IIPMFGIA

SEQ ID NO: 553 - DNA, 48 bp, Artificial Sequence
  Synthetic
gcgagaacaccgttttactatgatagtagtggttattaccttgactac

SEQ ID NO: 554 - protein, 16 aa, Artificial Sequence
  Synthetic
ARTPFYYDSSGYYLDY

SEQ ID NO: 555 - DNA, 324 bp, Artificial Sequence
  Synthetic
gaaattgtgttgacgcagtctccaggcaccctgtctttgtctccaggggaaagagccaccctctcttgcagggccagtcagagtgttagcagcaactacttagcctggtaccagcagagtcctggccaggctcccaggctcctcatctatggtgcatccagcagggccactggcatcccagacaggttcagtggcagtgggtctgggacagacttcactctcaccatcagcagactggagcctgaagattttgcagtttattactgtcagcagtatgttaggtcaccccggacgttcggccaagggaccaaggtggaaatcaaa

SEQ ID NO: 556 - protein, 108 aa, Artificial Sequence
  Synthetic
EIVLTQSPGTLSLSPGERATLSCRASQSVSSNYLAWYQQSPGQAPRLLIYGASSRATGIPDRFSGSGSGTDFTLTISRLEPEDFAVYYCQQYVRSPRTFGQGTKVEIK

SEQ ID NO: 557 - DNA, 21 bp, Artificial Sequence
  Synthetic
cagagtgttagcagcaactac

SEQ ID NO: 558 - protein, 7 aa, Artificial Sequence
  Synthetic
QSVSSNY

SEQ ID NO: 559 - DNA, 27 bp, Artificial Sequence
  Synthetic
cagcagtatgttaggtcaccccggacg

SEQ ID NO: 560 - protein, 9 aa, Artificial Sequence
  Synthetic
QQYVRSPRT

SEQ ID NO: 561 - DNA, 1362 bp, Artificial Sequence
  Synthetic
caggtgcagctggtgcagtctggggctgaggtgaagaagcctgggtcctcggtgaaggtctcctgcaaggcttctggaggcaccttcagcagctatgctatcacctgggtgcgacaggcccctggacaagggcttgagtggatgggaaggatcatccctatgtttggtatagcaaactacgcacagaagttccagggcagagtcacgattaccgcggacaaatccacgagcacagcctacatggaggtgagcagcctgagatctgaggacacggccgtgtattactgtgcgagaacaccgttttactatgatagtagtggttattaccttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 562 - protein, 453 aa, Artificial Sequence
  Synthetic
QVQLVQSGAEVKKPGSSVKVSCKASGGTFSSYAITWVRQAPGQGLEWMGRIIPMFGIANYAQKFQGRVTITADKSTSTAYMEVSSLRSEDTAVYYCARTPFYYDSSGYYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 563 - DNA, 648 bp, Artificial Sequence
  Synthetic
gaaattgtgttgacgcagtctccaggcaccctgtctttgtctccaggggaaagagccaccctctcttgcagggccagtcagagtgttagcagcaactacttagcctggtaccagcagagtcctggccaggctcccaggctcctcatctatggtgcatccagcagggccactggcatcccagacaggttcagtggcagtgggtctgggacagacttcactctcaccatcagcagactggagcctgaagattttgcagtttattactgtcagcagtatgttaggtcaccccggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 564 - protein, 215 aa, Artificial Sequence
  Synthetic
EIVLTQSPGTLSLSPGERATLSCRASQSVSSNYLAWYQQSPGQAPRLLIYGASSRATGIPDRFSGSGSGTDFTLTISRLEPEDFAVYYCQQYVRSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 565 - DNA, 1362 bp, Artificial Sequence
  Synthetic
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagacggccggactattactatggttcggggagttattgatgatgcttttgatatctggggccaagggacaatggtcaccgtctcttcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 566 - protein, 453 aa, Artificial Sequence
  Synthetic
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGRTITMVRGVIDDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 567 - DNA, 1341 bp, Artificial Sequence
  Synthetic
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagtacatactacgcagactccgtgaagggccgattcaccatctccagagacaattccaagaacacgctgtatcttcaaatgaacagactgagagctgacgacacggctgtctattactgtgtgagagatccggtggggcgctactactacggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 568 - protein, 446 aa, Artificial Sequence
  Synthetic
EVQLVESGGGLVQPGGSLRLSCAASGFTVSSNYMSWVRQAPGKGLEWVSVIYSGGSTYYADSVKGRFTISRDNSKNTLYLQMNRLRADDTAVYYCVRDPVGRYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 569 - DNA, 1332 bp, Artificial Sequence
  Synthetic
gaggtgcagctggtggagtctggaggaggcttgatccagcctggggggtccctgagactctcctgtgcagcctctggggtcaccgtcagtagcaactacatgagctgggtccgccaggctccagggaaggggctggagtgggtctcagtcatttatagcggcggtagcacattctactcagactccgtgaagggccgattcagcatctccagagacaattccaagaacacactgtatcttcaaatgaacagcctgagagccgaggacacggccgtgtattactgtgcgagagacctctactactacggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 570 - protein, 443 aa, Artificial Sequence
  Synthetic
EVQLVESGGGLIQPGGSLRLSCAASGVTVSSNYMSWVRQAPGKGLEWVSVIYSGGSTFYSDSVKGRFSISRDNSKNTLYLQMNSLRAEDTAVYYCARDLYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 571 - DNA, 1350 bp, Artificial Sequence
  Synthetic
caggtgcagctggtgcagtctggggctgaggtgaagaagcctgggtcctcggtgaaggtctcctgcaaggcttctggaggcaccttcagcagctatgctatcacctgggtgcgacaggcccctggacaagggcttgagtggatgggaaggatcatccctatgtttggtatagcaaactacgcacagaagttccagggcagagtcacgattaccgcggacaaatccacgagcacagcctacatggaggtgagcagcctgagatctgaggacacggccgtgtattactgtgcgagaacaccgttttactatgatagtagtggttattaccttgactactggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 572 - protein, 449 aa, Artificial Sequence
  Synthetic
QVQLVQSGAEVKKPGSSVKVSCKASGGTFSSYAITWVRQAPGQGLEWMGRIIPMFGIANYAQKFQGRVTITADKSTSTAYMEVSSLRSEDTAVYYCARTPFYYDSSGYYLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 573 - DNA, 357 bp, Artificial Sequence
  Synthetic
gaggtgcagctggtggagtctggaggaggcttggtccagcctggggggtccctgagactctcctgtgcagcctctgggctcaccgtcagtagcaactacatgagctgggtccgccaggctccagggaagggactggagtgggtctcagttatttatagcggaggtaccacatactacgcagactccgtgaagggccgattcaccatctccagacacaattccaagaacacgctgtctcttcaaatgaacagcctgagagctgaggacacggccgtgtattactgtgcgcgaggggagggggccaactactacggtatggacgtctggggccaagggaccacggtcaccgtctcctca

SEQ ID NO: 574 - protein, 119 aa, Artificial Sequence
  Synthetic
EVQLVESGGGLVQPGGSLRLSCAASGLTVSSNYMSWVRQAPGKGLEWVSVIYSGGTTYYADSVKGRFTISRHNSKNTLSLQMNSLRAEDTAVYYCARGEGANYYGMDVWGQGTTVTVSS

SEQ ID NO: 575 - DNA, 21 bp, Artificial Sequence
  Synthetic
atttatagcggaggtaccaca

SEQ ID NO: 576 - protein, 7 aa, Artificial Sequence
  Synthetic
IYSGGTT

SEQ ID NO: 577 - DNA, 39 bp, Artificial Sequence
  Synthetic
gcgcgaggggagggggccaactactacggtatggacgtc

SEQ ID NO: 578 - protein, 13 aa, Artificial Sequence
  Synthetic
ARGEGANYYGMDV

SEQ ID NO: 579 - DNA, 336 bp, Artificial Sequence
  Synthetic
cagtctgtgctgacgcagccgccctcagtgtctggggccccagggcagagggtcaccatctcctgcactgggagcagctccaacatcgggacaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttatgtggtattcggcggagggaccaagctgaccgtccta

SEQ ID NO: 580 - protein, 112 aa, Artificial Sequence
  Synthetic
QSVLTQPPSVSGAPGQRVTISCTGSSSNIGTGYDVHWYQQLPGTAPKLLIYGNSNRPSGVPDRFSGSKSGTSASLAITGLQAEDEADYYCQSYDSSLSGYVVFGGGTKLTVL

SEQ ID NO: 581 - DNA, 27 bp, Artificial Sequence
  Synthetic
agctccaacatcgggacaggttatgat

SEQ ID NO: 582 - protein, 9 aa, Artificial Sequence
  Synthetic
SSNIGTGYD

SEQ ID NO: 583 - DNA, 9 bp, Artificial Sequence
  Synthetic
ggtaacagc

SEQ ID NO: 584 - protein, 3 aa, Artificial Sequence
  Synthetic
GNS

SEQ ID NO: 585 - DNA, 36 bp, Artificial Sequence
  Synthetic
cagtcctatgacagcagcctgagtggttatgtggta

SEQ ID NO: 586 - protein, 12 aa, Artificial Sequence
  Synthetic
QSYDSSLSGYVV

SEQ ID NO: 587 - DNA, 1350 bp, Artificial Sequence
  Synthetic
gaggtgcagctggtggagtctggaggaggcttggtccagcctggggggtccctgagactctcctgtgcagcctctgggctcaccgtcagtagcaactacatgagctgggtccgccaggctccagggaagggactggagtgggtctcagttatttatagcggaggtaccacatactacgcagactccgtgaagggccgattcaccatctccagacacaattccaagaacacgctgtctcttcaaatgaacagcctgagagctgaggacacggccgtgtattactgtgcgcgaggggagggggccaactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 588 - protein, 449 aa, Artificial Sequence
  Synthetic
EVQLVESGGGLVQPGGSLRLSCAASGLTVSSNYMSWVRQAPGKGLEWVSVIYSGGTTYYADSVKGRFTISRHNSKNTLSLQMNSLRAEDTAVYYCARGEGANYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 589 - DNA, 657 bp, Artificial Sequence
  Synthetic
cagtctgtgctgacgcagccgccctcagtgtctggggccccagggcagagggtcaccatctcctgcactgggagcagctccaacatcgggacaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttatgtggtattcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 590 - protein, 218 aa, Artificial Sequence
  Synthetic
QSVLTQPPSVSGAPGQRVTISCTGSSSNIGTGYDVHWYQQLPGTAPKLLIYGNSNRPSGVPDRFSGSKSGTSASLAITGLQAEDEADYYCQSYDSSLSGYVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 591 - DNA, 1338 bp, Artificial Sequence
  Synthetic
gaggtgcagctggtggagtctggaggaggcttggtccagcctggggggtccctgagactctcctgtgcagcctctgggctcaccgtcagtagcaactacatgagctgggtccgccaggctccagggaagggactggagtgggtctcagttatttatagcggaggtaccacatactacgcagactccgtgaagggccgattcaccatctccagacacaattccaagaacacgctgtctcttcaaatgaacagcctgagagctgaggacacggccgtgtattactgtgcgcgaggggagggggccaactactacggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 592 - protein, 445 aa, Artificial Sequence
  Synthetic
EVQLVESGGGLVQPGGSLRLSCAASGLTVSSNYMSWVRQAPGKGLEWVSVIYSGGTTYYADSVKGRFTISRHNSKNTLSLQMNSLRAEDTAVYYCARGEGANYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 593 - DNA, 357 bp, Artificial Sequence
  Synthetic
gaggtgcagctggtggagtctgggggaggcttggtccagcctggggggtccctgagactctcctgtgcagcctctggactcaccgtcaatcgcaactacatgagctgggtccgccaggctccagggaaggggctggagtgggtctcacttatttatagcggtggtagcacatactacgcagactccgttaagggccgattcaccatctccagagacaattccaagaacacgctgtatcttcaaatgaacagcctgagacttgaggacacggctgtgtattactgtgcgagaggtgaactggggatcccctacggtatggacgtctggggccaagggaccacggtcaccgtctcctca

SEQ ID NO: 594 - protein, 119 aa, Artificial Sequence
  Synthetic
EVQLVESGGGLVQPGGSLRLSCAASGLTVNRNYMSWVRQAPGKGLEWVSLIYSGGSTYYADSVKGRFTISRDNSKNTLYLQMNSLRLEDTAVYYCARGELGIPYGMDVWGQGTTVTVSS

SEQ ID NO: 595 - DNA, 24 bp, Artificial Sequence
  Synthetic
ggactcaccgtcaatcgcaactac

SEQ ID NO: 596 - protein, 8 aa, Artificial Sequence
  Synthetic
GLTVNRNY

SEQ ID NO: 597 - DNA, 39 bp, Artificial Sequence
  Synthetic
gcgagaggtgaactggggatcccctacggtatggacgtc

SEQ ID NO: 598 - protein, 13 aa, Artificial Sequence
  Synthetic
ARGELGIPYGMDV

SEQ ID NO: 599 - DNA, 330 bp, Artificial Sequence
  Synthetic
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgcttctctggctccaagtctggcacgtcagccaccctgggcatcaccggactccagactggggacgaggccgattattactgcggaacatgggatagcagcctgagtgctggggtgttcggcggagggaccaagctgaccgtccta

SEQ ID NO: 600 - protein, 110 aa, Artificial Sequence
  Synthetic
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVL

SEQ ID NO: 601 - DNA, 33 bp, Artificial Sequence
  Synthetic
ggaacatgggatagcagcctgagtgctggggtg

SEQ ID NO: 602 - protein, 11 aa, Artificial Sequence
  Synthetic
GTWDSSLSAGV

SEQ ID NO: 603 - DNA, 1350 bp, Artificial Sequence
  Synthetic
gaggtgcagctggtggagtctgggggaggcttggtccagcctggggggtccctgagactctcctgtgcagcctctggactcaccgtcaatcgcaactacatgagctgggtccgccaggctccagggaaggggctggagtgggtctcacttatttatagcggtggtagcacatactacgcagactccgttaagggccgattcaccatctccagagacaattccaagaacacgctgtatcttcaaatgaacagcctgagacttgaggacacggctgtgtattactgtgcgagaggtgaactggggatcccctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 604 - protein, 449 aa, Artificial Sequence
  Synthetic
EVQLVESGGGLVQPGGSLRLSCAASGLTVNRNYMSWVRQAPGKGLEWVSLIYSGGSTYYADSVKGRFTISRDNSKNTLYLQMNSLRLEDTAVYYCARGELGIPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 605 - DNA, 651 bp, Artificial Sequence
  Synthetic
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgcttctctggctccaagtctggcacgtcagccaccctgggcatcaccggactccagactggggacgaggccgattattactgcggaacatgggatagcagcctgagtgctggggtgttcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 606 - protein, 216 aa, Artificial Sequence
  Synthetic
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 607 - DNA, 384 bp, Artificial Sequence
  Synthetic
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaataggggtagcataggctatgcggactctgtgaagggccgattcaccatctccagagacaacgccaagaactccctgtatctgcaaatgagcagtctgagagctgaggacacggccttgtattactgcgcaaaagatggcgagagatgggatagtgtagtagtaccatctgctaggaacggtatggacgtctggggccaagggaccacggtcaccgtctcctca

SEQ ID NO: 608 - protein, 128 aa, Artificial Sequence
  Synthetic
EVQLVESGGGLVQPGRSLRLSCAASGFTFDDYAMHWVRQAPGKGLEWVSGISWNRGSIGYADSVKGRFTISRDNAKNSLYLQMSSLRAEDTALYYCAKDGERWDSVVVPSARNGMDVWGQGTTVTVSS

SEQ ID NO: 609 - DNA, 24 bp, Artificial Sequence
  Synthetic
attagttggaataggggtagcata

SEQ ID NO: 610 - protein, 8 aa, Artificial Sequence
  Synthetic
ISWNRGSI

SEQ ID NO: 611 - DNA, 63 bp, Artificial Sequence
  Synthetic
gcaaaagatggcgagagatgggatagtgtagtagtaccatctgctaggaacggtatggacgtc

SEQ ID NO: 612 - protein, 21 aa, Artificial Sequence
  Synthetic
AKDGERWDSVVVPSARNGMDV

SEQ ID NO: 613 - DNA, 336 bp, Artificial Sequence
  Synthetic
cagtctgtgctgacgcagccgccctcagtgtctggggccccagggcagagggtcaccatctcctgcactgggagcagctccaacatcggggcaggttatgatgtacattggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggctcttatgtcttcggaactgggaccaaggtcaccgtccta

SEQ ID NO: 614 - protein, 112 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKVTVL

SEQ ID NO: 615 - DNA, 27 bp, Artificial Sequence
  Synthetic
agctccaacatcggggcaggttatgat

SEQ ID NO: 616 - protein, 9 aa, Artificial Sequence
  Synthetic
SSNIGAGYD

SEQ ID NO: 617 - DNA, 36 bp, Artificial Sequence
  Synthetic
cagtcctatgacagcagcctgagtggctcttatgtc

SEQ ID NO: 618 - protein, 12 aa, Artificial Sequence
  Synthetic
QSYDSSLSGSYV

SEQ ID NO: 619 - DNA, 1377 bp, Artificial Sequence
  Synthetic
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaataggggtagcataggctatgcggactctgtgaagggccgattcaccatctccagagacaacgccaagaactccctgtatctgcaaatgagcagtctgagagctgaggacacggccttgtattactgcgcaaaagatggcgagagatgggatagtgtagtagtaccatctgctaggaacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 620 - protein, 458 aa, Artificial Sequence
  Synthetic
EVQLVESGGGLVQPGRSLRLSCAASGFTFDDYAMHWVRQAPGKGLEWVSGISWNRGSIGYADSVKGRFTISRDNAKNSLYLQMSSLRAEDTALYYCAKDGERWDSVVVPSARNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 621 - DNA, 657 bp, Artificial Sequence
  Synthetic
cagtctgtgctgacgcagccgccctcagtgtctggggccccagggcagagggtcaccatctcctgcactgggagcagctccaacatcggggcaggttatgatgtacattggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggctcttatgtcttcggaactgggaccaaggtcaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 622 - protein, 218 aa, Artificial Sequence
  Synthetic
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 623 - DNA, 357 bp, Artificial Sequence
  Synthetic
gaggtgcagctggtggagtctgggggaggcttggtccagcctggggggtccctgagactctcctgtgcagcctctgaattcaccgtcagtagcaactacatgagctgggtccgccaggctccagggaaggggctagagtgggtctcagttatttatagcggtggtagcacattttacgcagactccgtgaagggcagattcaccatctccagagacaattccaagaacacgttgtatcttcaaatgaacagtctgagagccgaggacacggctgtatattactgtgcgagagctcttccctacggtgacttgcattttgactactggggccagggaaccctggtcaccgtctcctca

SEQ ID NO: 624 - protein, 119 aa, Artificial Sequence
  Synthetic
EVQLVESGGGLVQPGGSLRLSCAASEFTVSSNYMSWVRQAPGKGLEWVSVIYSGGSTFYADSVKGRFTISRDNSKNTLYLQMNSLRAEDTAVYYCARALPYGDLHFDYWGQGTLVTVSS

SEQ ID NO: 625 - DNA, 24 bp, Artificial Sequence
  Synthetic
gaattcaccgtcagtagcaactac

SEQ ID NO: 626 - protein, 8 aa, Artificial Sequence
  Synthetic
EFTVSSNY

SEQ ID NO: 627 - DNA, 39 bp, Artificial Sequence
  Synthetic
gcgagagctcttccctacggtgacttgcattttgactac

SEQ ID NO: 628 - protein, 13 aa, Artificial Sequence
  Synthetic
ARALPYGDLHFDY

SEQ ID NO: 629 - DNA, 336 bp, Artificial Sequence
  Synthetic
cagtctgtgctgacgcagccgccctcagtgtctggggccccagggcagagggtcaccatctcctgcactgggagcagctccaacatcgggacaggttatgatgtacactggtaccagcagcttccaggaacagcccccaaactcctcatctatggtaacaccaatcggccctcaggggtccctgaccgattctctggctccaagtctggcacctcagcctccctggccatcactgggctccaggctgaggatgaggctgattattactgccagtcctatgacagcagcctgagtgactcttatgtcttcggaactgggaccaaggtcaccgtccta

SEQ ID NO: 630 - protein, 112 aa, Artificial Sequence
  Synthetic
QSVLTQPPSVSGAPGQRVTISCTGSSSNIGTGYDVHWYQQLPGTAPKLLIYGNTNRPSGVPDRFSGSKSGTSASLAITGLQAEDEADYYCQSYDSSLSDSYVFGTGTKVTVL

SEQ ID NO: 631 - DNA, 9 bp, Artificial Sequence
  Synthetic
ggtaacacc

SEQ ID NO: 632 - protein, 3 aa, Artificial Sequence
  Synthetic
GNT

SEQ ID NO: 633 - DNA, 36 bp, Artificial Sequence
  Synthetic
cagtcctatgacagcagcctgagtgactcttatgtc

SEQ ID NO: 634 - protein, 12 aa, Artificial Sequence
  Synthetic
QSYDSSLSDSYV

SEQ ID NO: 635 - DNA, 1350 bp, Artificial Sequence
  Synthetic
gaggtgcagctggtggagtctgggggaggcttggtccagcctggggggtccctgagactctcctgtgcagcctctgaattcaccgtcagtagcaactacatgagctgggtccgccaggctccagggaaggggctagagtgggtctcagttatttatagcggtggtagcacattttacgcagactccgtgaagggcagattcaccatctccagagacaattccaagaacacgttgtatcttcaaatgaacagtctgagagccgaggacacggctgtatattactgtgcgagagctcttccctacggtgacttgcattttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 636 - protein, 449 aa, Artificial Sequence
  Synthetic
EVQLVESGGGLVQPGGSLRLSCAASEFTVSSNYMSWVRQAPGKGLEWVSVIYSGGSTFYADSVKGRFTISRDNSKNTLYLQMNSLRAEDTAVYYCARALPYGDLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 637 - DNA, 657 bp, Artificial Sequence
  Synthetic
cagtctgtgctgacgcagccgccctcagtgtctggggccccagggcagagggtcaccatctcctgcactgggagcagctccaacatcgggacaggttatgatgtacactggtaccagcagcttccaggaacagcccccaaactcctcatctatggtaacaccaatcggccctcaggggtccctgaccgattctctggctccaagtctggcacctcagcctccctggccatcactgggctccaggctgaggatgaggctgattattactgccagtcctatgacagcagcctgagtgactcttatgtcttcggaactgggaccaaggtcaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 638 - protein, 218 aa, Artificial Sequence
  Synthetic
QSVLTQPPSVSGAPGQRVTISCTGSSSNIGTGYDVHWYQQLPGTAPKLLIYGNTNRPSGVPDRFSGSKSGTSASLAITGLQAEDEADYYCQSYDSSLSDSYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 639 - DNA, 360 bp, Artificial Sequence
  Synthetic
caggtgcagctggtggagtctgggggaggcgtggtccagcctgggaggtccctgagactctcctgtgcagcctctggattcaccttcagtaactatgctatgtactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagaactgaggacacggctgtgtattactgtgcgagtggctccgactacggtgactacttattggtttactggggccagggaaccctggtcaccgtctcctca

SEQ ID NO: 640 - protein, 120 aa, Artificial Sequence
  Synthetic
QVQLVESGGGVVQPGRSLRLSCAASGFTFSNYAMYWVRQAPGKGLEWVAVISYDGSNKYYADSVKGRFTISRDNSKNTLYLQMNSLRTEDTAVYYCASGSDYGDYLLVYWGQGTLVTVSS

SEQ ID NO: 641 - DNA, 24 bp, Artificial Sequence
  Synthetic
ggattcaccttcagtaactatgct

SEQ ID NO: 642 - protein, 8 aa, Artificial Sequence
  Synthetic
GFTFSNYA

SEQ ID NO: 643 - DNA, 39 bp, Artificial Sequence
  Synthetic
gcgagtggctccgactacggtgactacttattggtttac

SEQ ID NO: 644 - protein, 13 aa, Artificial Sequence
  Synthetic
ASGSDYGDYLLVY

SEQ ID NO: 645 - DNA, 330 bp, Artificial Sequence
  Synthetic
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaagcggccctcaggggtttctaatcgcttctctggctccaagtctggcaacacggcctccctgaccatctctgggctccagtctgaggacgaggctgattattactgcaactctttgacaagcatcagcacttgggtgttcggcggagggaccaagctgaccgtccta

SEQ ID NO: 646 - protein, 110 aa, Artificial Sequence
  Synthetic
QSALTQPASVSGSPGQSITISCTGTSSDVGGYNYVSWYQQHPGKAPKLMIYDVSKRPSGVSNRFSGSKSGNTASLTISGLQSEDEADYYCNSLTSISTWVFGGGTKLTVL

SEQ ID NO: 647 - DNA, 27 bp, Artificial Sequence
  Synthetic
agcagtgacgttggtggttataactat

SEQ ID NO: 648 - protein, 9 aa, Artificial Sequence
  Synthetic
SSDVGGYNY

SEQ ID NO: 649 - DNA, 9 bp, Artificial Sequence
  Synthetic
gatgtcagt

SEQ ID NO: 650 - protein, 3 aa, Artificial Sequence
  Synthetic
DVS

SEQ ID NO: 651 - DNA, 30 bp, Artificial Sequence
  Synthetic
aactctttgacaagcatcagcacttgggtg

SEQ ID NO: 652 - protein, 10 aa, Artificial Sequence
  Synthetic
NSLTSISTWV

SEQ ID NO: 653 - DNA, 1353 bp, Artificial Sequence
  Synthetic
caggtgcagctggtggagtctgggggaggcgtggtccagcctgggaggtccctgagactctcctgtgcagcctctggattcaccttcagtaactatgctatgtactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagaactgaggacacggctgtgtattactgtgcgagtggctccgactacggtgactacttattggtttactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 654 - protein, 450 aa, Artificial Sequence
  Synthetic
QVQLVESGGGVVQPGRSLRLSCAASGFTFSNYAMYWVRQAPGKGLEWVAVISYDGSNKYYADSVKGRFTISRDNSKNTLYLQMNSLRTEDTAVYYCASGSDYGDYLLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 655 - DNA, 651 bp, Artificial Sequence
  Synthetic
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaagcggccctcaggggtttctaatcgcttctctggctccaagtctggcaacacggcctccctgaccatctctgggctccagtctgaggacgaggctgattattactgcaactctttgacaagcatcagcacttgggtgttcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 656 - protein, 216 aa, Artificial Sequence
  Synthetic
QSALTQPASVSGSPGQSITISCTGTSSDVGGYNYVSWYQQHPGKAPKLMIYDVSKRPSGVSNRFSGSKSGNTASLTISGLQSEDEADYYCNSLTSISTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 657 - DNA, 381 bp, Artificial Sequence
  Synthetic
gaggtgcagctggtggagtctgggggaggcttggtacagcctggagggtccctgagactctcctgtacagcctctggattcaccttcagtaattatgaaatgaactgggtccgccaggctccagggaaggggctggagtgggtttcatacattagtagtaggagtggtagtaccctacactacgcagactctgtgaagggccgattcaccatctccagagacaacgccaagaactcactgtatctgcaaatgaacagcctgagagccgaggacacggctgtttattactgtgcgagaaggggcgatggtaccagctccctaatccaccactactactacatggacgtctggggcaaagggaccacggtcaccgtctcctca

SEQ ID NO: 658 - protein, 127 aa, Artificial Sequence
  Synthetic
EVQLVESGGGLVQPGGSLRLSCTASGFTFSNYEMNWVRQAPGKGLEWVSYISSRSGSTLHYADSVKGRFTISRDNAKNSLYLQMNSLRAEDTAVYYCARRGDGTSSLIHHYYYMDVWGKGTTVTVSS

SEQ ID NO: 659 - DNA, 24 bp, Artificial Sequence
  Synthetic
ggattcaccttcagtaattatgaa

SEQ ID NO: 660 - protein, 8 aa, Artificial Sequence
  Synthetic
GFTFSNYE

SEQ ID NO: 661 - DNA, 27 bp, Artificial Sequence
  Synthetic
attagtagtaggagtggtagtacccta

SEQ ID NO: 662 - protein, 9 aa, Artificial Sequence
  Synthetic
ISSRSGSTL

SEQ ID NO: 663 - DNA, 57 bp, Artificial Sequence
  Synthetic
gcgagaaggggcgatggtaccagctccctaatccaccactactactacatggacgtc

SEQ ID NO: 664 - protein, 19 aa, Artificial Sequence
  Synthetic
ARRGDGTSSLIHHYYYMDV

SEQ ID NO: 665 - DNA, 330 bp, Artificial Sequence
  Synthetic
cagtctgtgctgactcagccaccctcagcgtctgggacccccgggcagagggtcaccatctcttgttctggaagcagctccaacatcggaagtaatactgtaaactggtaccaacagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtccta

SEQ ID NO: 666 - protein, 110 aa, Artificial Sequence
  Synthetic
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVFGGGTKLTVL

SEQ ID NO: 667 - DNA, 24 bp, Artificial Sequence
  Synthetic
agctccaacatcggaagtaatact

SEQ ID NO: 668 - protein, 8 aa, Artificial Sequence
  Synthetic
SSNIGSNT

SEQ ID NO: 669 - DNA, 9 bp, Artificial Sequence
  Synthetic
agtaataat

SEQ ID NO: 670 - protein, 3 aa, Artificial Sequence
  Synthetic
SNN

SEQ ID NO: 671 - DNA, 33 bp, Artificial Sequence
  Synthetic
gcagcatgggatgacagcctgaatggtccggta

SEQ ID NO: 672 - protein, 11 aa, Artificial Sequence
  Synthetic
AAWDDSLNGPV

SEQ ID NO: 673 - DNA, 1374 bp, Artificial Sequence
  Synthetic
gaggtgcagctggtggagtctgggggaggcttggtacagcctggagggtccctgagactctcctgtacagcctctggattcaccttcagtaattatgaaatgaactgggtccgccaggctccagggaaggggctggagtgggtttcatacattagtagtaggagtggtagtaccctacactacgcagactctgtgaagggccgattcaccatctccagagacaacgccaagaactcactgtatctgcaaatgaacagcctgagagccgaggacacggctgtttattactgtgcgagaaggggcgatggtaccagctccctaatccaccactactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 674 - protein, 457 aa, Artificial Sequence
  Synthetic
EVQLVESGGGLVQPGGSLRLSCTASGFTFSNYEMNWVRQAPGKGLEWVSYISSRSGSTLHYADSVKGRFTISRDNAKNSLYLQMNSLRAEDTAVYYCARRGDGTSSLIHHYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 675 - DNA, 651 bp, Artificial Sequence
  Synthetic
cagtctgtgctgactcagccaccctcagcgtctgggacccccgggcagagggtcaccatctcttgttctggaagcagctccaacatcggaagtaatactgtaaactggtaccaacagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 676 - protein, 216 aa, Artificial Sequence
  Synthetic
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 677 - DNA, 369 bp, Artificial Sequence
  Synthetic
caggtgcagctggtgcagtctggggctgaggtgaagaagcctggggcctcagtgaaggtctcctgcaaggcttctggatacatcttcaccggctactatatgcactgggtgcgacaggcccctggacaggggcttgagtggatgggatggatcaaccctaacagtggtggcgcaaactatgcacagaagtttcagggcagggtcaccctgaccagggacacgtccatcaccacagtctacatggaactgagcaggctgagatttgacgacacggccgtgtattactgtgcgagaggatcccggtatgactggaaccagaacaactggttcgacccctggggccagggaaccctggtcaccgtctcctca

SEQ ID NO: 678 - protein, 123 aa, Artificial Sequence
  Synthetic
QVQLVQSGAEVKKPGASVKVSCKASGYIFTGYYMHWVRQAPGQGLEWMGWINPNSGGANYAQKFQGRVTLTRDTSITTVYMELSRLRFDDTAVYYCARGSRYDWNQNNWFDPWGQGTLVTVSS

SEQ ID NO: 679 - DNA, 24 bp, Artificial Sequence
  Synthetic
ggatacatcttcaccggctactat

SEQ ID NO: 680 - protein, 8 aa, Artificial Sequence
  Synthetic
GYIFTGYY

SEQ ID NO: 681 - DNA, 24 bp, Artificial Sequence
  Synthetic
atcaaccctaacagtggtggcgca

SEQ ID NO: 682 - protein, 8 aa, Artificial Sequence
  Synthetic
INPNSGGA

SEQ ID NO: 683 - DNA, 48 bp, Artificial Sequence
  Synthetic
gcgagaggatcccggtatgactggaaccagaacaactggttcgacccc

SEQ ID NO: 684 - protein, 16 aa, Artificial Sequence
  Synthetic
ARGSRYDWNQNNWFDP

SEQ ID NO: 685 - DNA, 330 bp, Artificial Sequence
  Synthetic
cagtctgccctgactcagcctgcctccgtgtctgggtctcctggacagtcgatcaccatctcctgcactggaaccagcagtgacgttggtacttataactatgtctcctggtaccaacaacacccaggcaaagcccccaaactcatgatttttgatgtcagtaatcggccctcaggggtttctgatcgcttctctggctccaagtctggcaacacggcctccctgaccatctctgggctccaggctgaggacgaggctgattattactgcagctcatttacaaccagcagcactgtggttttcggcggagggaccaagctgaccgtccta

SEQ ID NO: 686 - protein, 110 aa, Artificial Sequence
  Synthetic
QSALTQPASVSGSPGQSITISCTGTSSDVGTYNYVSWYQQHPGKAPKLMIFDVSNRPSGVSDRFSGSKSGNTASLTISGLQAEDEADYYCSSFTTSSTVVFGGGTKLTVL

SEQ ID NO: 687 - DNA, 27 bp, Artificial Sequence
  Synthetic
agcagtgacgttggtacttataactat

SEQ ID NO: 688 - protein, 9 aa, Artificial Sequence
  Synthetic
SSDVGTYNY

SEQ ID NO: 689 - DNA, 30 bp, Artificial Sequence
  Synthetic
agctcatttacaaccagcagcactgtggtt

SEQ ID NO: 690 - protein, 10 aa, Artificial Sequence
  Synthetic
SSFTTSSTVV

SEQ ID NO: 691 - DNA, 1362 bp, Artificial Sequence
  Synthetic
caggtgcagctggtgcagtctggggctgaggtgaagaagcctggggcctcagtgaaggtctcctgcaaggcttctggatacatcttcaccggctactatatgcactgggtgcgacaggcccctggacaggggcttgagtggatgggatggatcaaccctaacagtggtggcgcaaactatgcacagaagtttcagggcagggtcaccctgaccagggacacgtccatcaccacagtctacatggaactgagcaggctgagatttgacgacacggccgtgtattactgtgcgagaggatcccggtatgactggaaccagaacaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 692 - protein, 453 aa, Artificial Sequence
  Synthetic
QVQLVQSGAEVKKPGASVKVSCKASGYIFTGYYMHWVRQAPGQGLEWMGWINPNSGGANYAQKFQGRVTLTRDTSITTVYMELSRLRFDDTAVYYCARGSRYDWNQNNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 693 - DNA, 651 bp, Artificial Sequence
  Synthetic
cagtctgccctgactcagcctgcctccgtgtctgggtctcctggacagtcgatcaccatctcctgcactggaaccagcagtgacgttggtacttataactatgtctcctggtaccaacaacacccaggcaaagcccccaaactcatgatttttgatgtcagtaatcggccctcaggggtttctgatcgcttctctggctccaagtctggcaacacggcctccctgaccatctctgggctccaggctgaggacgaggctgattattactgcagctcatttacaaccagcagcactgtggttttcggcggagggaccaagctgaccgtcctaggccagcccaaggccgccccctccgtgaccctgttccccccctcctccgaggagctgcaggccaacaaggccaccctggtgtgcctgatctccgacttctaccccggcgccgtgaccgtggcctggaaggccgactcctcccccgtgaaggccggcgtggagaccaccaccccctccaagcagtccaacaacaagtacgccgcctcctcctacctgtccctgacccccgagcagtggaagtcccaccggtcctactcctgccaggtgacccacgagggctccaccgtggagaagaccgtggcccccaccgagtgctcctga

SEQ ID NO: 694 - protein, 216 aa, Artificial Sequence
  Synthetic
QSALTQPASVSGSPGQSITISCTGTSSDVGTYNYVSWYQQHPGKAPKLMIFDVSNRPSGVSDRFSGSKSGNTASLTISGLQAEDEADYYCSSFTTSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 695 - DNA, 1338 bp, Artificial Sequence
  Synthetic
gaggtgcagctggtggagtctgggggaggcttggtccagcctggggggtccctgagactctcctgtgcagcctctggactcaccgtcaatcgcaactacatgagctgggtccgccaggctccagggaaggggctggagtgggtctcacttatttatagcggtggtagcacatactacgcagactccgttaagggccgattcaccatctccagagacaattccaagaacacgctgtatcttcaaatgaacagcctgagacttgaggacacggctgtgtattactgtgcgagaggtgaactggggatcccctacggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 696 - protein, 445 aa, Artificial Sequence
  Synthetic
EVQLVESGGGLVQPGGSLRLSCAASGLTVNRNYMSWVRQAPGKGLEWVSLIYSGGSTYYADSVKGRFTISRDNSKNTLYLQMNSLRLEDTAVYYCARGELGIPYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 697 - DNA, 1365 bp, Artificial Sequence
  Synthetic
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaataggggtagcataggctatgcggactctgtgaagggccgattcaccatctccagagacaacgccaagaactccctgtatctgcaaatgagcagtctgagagctgaggacacggccttgtattactgcgcaaaagatggcgagagatgggatagtgtagtagtaccatctgctaggaacggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 698 - protein, 454 aa, Artificial Sequence
  Synthetic
EVQLVESGGGLVQPGRSLRLSCAASGFTFDDYAMHWVRQAPGKGLEWVSGISWNRGSIGYADSVKGRFTISRDNAKNSLYLQMSSLRAEDTALYYCAKDGERWDSVVVPSARNGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 699 - DNA, 1338 bp, Artificial Sequence
  Synthetic
gaggtgcagctggtggagtctgggggaggcttggtccagcctggggggtccctgagactctcctgtgcagcctctgaattcaccgtcagtagcaactacatgagctgggtccgccaggctccagggaaggggctagagtgggtctcagttatttatagcggtggtagcacattttacgcagactccgtgaagggcagattcaccatctccagagacaattccaagaacacgttgtatcttcaaatgaacagtctgagagccgaggacacggctgtatattactgtgcgagagctcttccctacggtgacttgcattttgactactggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 700 - protein, 445 aa, Artificial Sequence
  Synthetic
EVQLVESGGGLVQPGGSLRLSCAASEFTVSSNYMSWVRQAPGKGLEWVSVIYSGGSTFYADSVKGRFTISRDNSKNTLYLQMNSLRAEDTAVYYCARALPYGDLHFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 701 - DNA, 1341 bp, Artificial Sequence
  Synthetic
caggtgcagctggtggagtctgggggaggcgtggtccagcctgggaggtccctgagactctcctgtgcagcctctggattcaccttcagtaactatgctatgtactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagaactgaggacacggctgtgtattactgtgcgagtggctccgactacggtgactacttattggtttactggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 702 - protein, 446 aa, Artificial Sequence
  Synthetic
QVQLVESGGGVVQPGRSLRLSCAASGFTFSNYAMYWVRQAPGKGLEWVAVISYDGSNKYYADSVKGRFTISRDNSKNTLYLQMNSLRTEDTAVYYCASGSDYGDYLLVYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 703 - DNA, 1362 bp, Artificial Sequence
  Synthetic
gaggtgcagctggtggagtctgggggaggcttggtacagcctggagggtccctgagactctcctgtacagcctctggattcaccttcagtaattatgaaatgaactgggtccgccaggctccagggaaggggctggagtgggtttcatacattagtagtaggagtggtagtaccctacactacgcagactctgtgaagggccgattcaccatctccagagacaacgccaagaactcactgtatctgcaaatgaacagcctgagagccgaggacacggctgtttattactgtgcgagaaggggcgatggtaccagctccctaatccaccactactactacatggacgtctggggcaaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 704 - protein, 453 aa, Artificial Sequence
  Synthetic
EVQLVESGGGLVQPGGSLRLSCTASGFTFSNYEMNWVRQAPGKGLEWVSYISSRSGSTLHYADSVKGRFTISRDNAKNSLYLQMNSLRAEDTAVYYCARRGDGTSSLIHHYYYMDVWGKGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 705 - DNA, 1350 bp, Artificial Sequence
  Synthetic
caggtgcagctggtgcagtctggggctgaggtgaagaagcctggggcctcagtgaaggtctcctgcaaggcttctggatacatcttcaccggctactatatgcactgggtgcgacaggcccctggacaggggcttgagtggatgggatggatcaaccctaacagtggtggcgcaaactatgcacagaagtttcagggcagggtcaccctgaccagggacacgtccatcaccacagtctacatggaactgagcaggctgagatttgacgacacggccgtgtattactgtgcgagaggatcccggtatgactggaaccagaacaactggttcgacccctggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 706 - protein, 449 aa, Artificial Sequence
  Synthetic
QVQLVQSGAEVKKPGASVKVSCKASGYIFTGYYMHWVRQAPGQGLEWMGWINPNSGGANYAQKFQGRVTLTRDTSITTVYMELSRLRFDDTAVYYCARGSRYDWNQNNWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 707 - DNA, 351 bp, Artificial Sequence
  Synthetic
gaggtgcagatggtggagtctggaggaggcttggtccagcctggggggtccctgagactctcctgtgcagcctctgggttcaccgtcagtagtaactacatgacctgggtccgccaggctccagggaaggggctggagtgggtctcagttatttatagcggtggtagcacatactacgcagactccgtgaagggccgattcaccatctccagacacaattccaagaacacgctgtatcttcaaatgaacagcctgagagctgaggacacggccgtgtattactgtgcgagagatggggtatcctacggtatggacgtctggggccaagggaccacggtcaccgtctcctca

SEQ ID NO: 708 - protein, 117 aa, Artificial Sequence
  Synthetic
EVQMVESGGGLVQPGGSLRLSCAASGFTVSSNYMTWVRQAPGKGLEWVSVIYSGGSTYYADSVKGRFTISRHNSKNTLYLQMNSLRAEDTAVYYCARDGVSYGMDVWGQGTTVTVSS

SEQ ID NO: 709 - DNA, 24 bp, Artificial Sequence
  Synthetic
gggttcaccgtcagtagtaactac

SEQ ID NO: 710 - DNA, 33 bp, Artificial Sequence
  Synthetic
gcgagagatggggtatcctacggtatggacgtc

SEQ ID NO: 711 - protein, 11 aa, Artificial Sequence
  Synthetic
ARDGVSYGMDV

SEQ ID NO: 712 - DNA, 324 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccgtcaaggttcagtggcagtggatctgggacagatttcactctcaccatcagcagtctgcaacctgaagattttgcaacttactactgtcaacagagttacagtacccctccgatcaccttcggccaagggacacgactggagattaaa

SEQ ID NO: 713 - protein, 108 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIK

SEQ ID NO: 714 - DNA, 30 bp, Artificial Sequence
  Synthetic
caacagagttacagtacccctccgatcacc

SEQ ID NO: 715 - protein, 10 aa, Artificial Sequence
  Synthetic
QQSYSTPPIT

SEQ ID NO: 716 - DNA, 1344 bp, Artificial Sequence
  Synthetic
gaggtgcagatggtggagtctggaggaggcttggtccagcctggggggtccctgagactctcctgtgcagcctctgggttcaccgtcagtagtaactacatgacctgggtccgccaggctccagggaaggggctggagtgggtctcagttatttatagcggtggtagcacatactacgcagactccgtgaagggccgattcaccatctccagacacaattccaagaacacgctgtatcttcaaatgaacagcctgagagctgaggacacggccgtgtattactgtgcgagagatggggtatcctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 717 - protein, 447 aa, Artificial Sequence
  Synthetic
EVQMVESGGGLVQPGGSLRLSCAASGFTVSSNYMTWVRQAPGKGLEWVSVIYSGGSTYYADSVKGRFTISRHNSKNTLYLQMNSLRAEDTAVYYCARDGVSYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 718 - DNA, 648 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccgtcaaggttcagtggcagtggatctgggacagatttcactctcaccatcagcagtctgcaacctgaagattttgcaacttactactgtcaacagagttacagtacccctccgatcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 719 - protein, 215 aa, Artificial Sequence
  Synthetic
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 720 - DNA, 1332 bp, Artificial Sequence
  Synthetic
gaggtgcagatggtggagtctggaggaggcttggtccagcctggggggtccctgagactctcctgtgcagcctctgggttcaccgtcagtagtaactacatgacctgggtccgccaggctccagggaaggggctggagtgggtctcagttatttatagcggtggtagcacatactacgcagactccgtgaagggccgattcaccatctccagacacaattccaagaacacgctgtatcttcaaatgaacagcctgagagctgaggacacggccgtgtattactgtgcgagagatggggtatcctacggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 721 - protein, 443 aa, Artificial Sequence
  Synthetic
EVQMVESGGGLVQPGGSLRLSCAASGFTVSSNYMTWVRQAPGKGLEWVSVIYSGGSTYYADSVKGRFTISRHNSKNTLYLQMNSLRAEDTAVYYCARDGVSYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 722 - DNA, 357 bp, Artificial Sequence
  Synthetic
gaggtgcagctggtggagtctggaggaggcttggtccaccctggggggtccctgagactctcctgtgcagcctctgggctcaccgtcagtagcaactacatgagctgggtccgccaggctccagggaaggggctggagtgggtctcagttatttatagcggtggtagcacatactacgcagactccgtgaagggccgattcaccatctccagacacaattccaagaacacgctgtttcttcaaatgaacagcctgagagctgaggacacggccgtgtattactgtgcgagagatcggccaataactggaaccactttggacgtctggggccaagggaccacggtcaccgtctcctca

SEQ ID NO: 723 - protein, 119 aa, Artificial Sequence
  Synthetic
EVQLVESGGGLVHPGGSLRLSCAASGLTVSSNYMSWVRQAPGKGLEWVSVIYSGGSTYYADSVKGRFTISRHNSKNTLFLQMNSLRAEDTAVYYCARDRPITGTTLDVWGQGTTVTVSS

SEQ ID NO: 724 - DNA, 39 bp, Artificial Sequence
  Synthetic
gcgagagatcggccaataactggaaccactttggacgtc

SEQ ID NO: 725 - protein, 13 aa, Artificial Sequence
  Synthetic
ARDRPITGTTLDV

SEQ ID NO: 726 - DNA, 324 bp, Artificial Sequence
  Synthetic
gacatccagatgacccagtctccatcctccctgtttgcatctgtaggggacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcattttactactgtcaacagacttacagtacccctccgatcaccttcggccaagggacacgactggagattaaa

SEQ ID NO: 727 - protein, 108 aa, Artificial Sequence
  Synthetic
DIQMTQSPSSLFASVGDRVTITCRASQSISSYLNWYQQKPGKAPKLLIYAASSLQSGVPSRFSGSGSGTDFTLTISSLQPEDFAFYYCQQTYSTPPITFGQGTRLEIK

SEQ ID NO: 728 - DNA, 30 bp, Artificial Sequence
  Synthetic
caacagacttacagtacccctccgatcacc

SEQ ID NO: 729 - protein, 10 aa, Artificial Sequence
  Synthetic
QQTYSTPPIT

SEQ ID NO: 730 - DNA, 1350 bp, Artificial Sequence
  Synthetic
gaggtgcagctggtggagtctggaggaggcttggtccaccctggggggtccctgagactctcctgtgcagcctctgggctcaccgtcagtagcaactacatgagctgggtccgccaggctccagggaaggggctggagtgggtctcagttatttatagcggtggtagcacatactacgcagactccgtgaagggccgattcaccatctccagacacaattccaagaacacgctgtttcttcaaatgaacagcctgagagctgaggacacggccgtgtattactgtgcgagagatcggccaataactggaaccactttggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 731 - protein, 449 aa, Artificial Sequence
  Synthetic
EVQLVESGGGLVHPGGSLRLSCAASGLTVSSNYMSWVRQAPGKGLEWVSVIYSGGSTYYADSVKGRFTISRHNSKNTLFLQMNSLRAEDTAVYYCARDRPITGTTLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 732 - DNA, 648 bp, Artificial Sequence
  Synthetic
gacatccagatgacccagtctccatcctccctgtttgcatctgtaggggacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcattttactactgtcaacagacttacagtacccctccgatcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 733 - protein, 215 aa, Artificial Sequence
  Synthetic
DIQMTQSPSSLFASVGDRVTITCRASQSISSYLNWYQQKPGKAPKLLIYAASSLQSGVPSRFSGSGSGTDFTLTISSLQPEDFAFYYCQQTYSTPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 734 - DNA, 1338 bp, Artificial Sequence
  Synthetic
gaggtgcagctggtggagtctggaggaggcttggtccaccctggggggtccctgagactctcctgtgcagcctctgggctcaccgtcagtagcaactacatgagctgggtccgccaggctccagggaaggggctggagtgggtctcagttatttatagcggtggtagcacatactacgcagactccgtgaagggccgattcaccatctccagacacaattccaagaacacgctgtttcttcaaatgaacagcctgagagctgaggacacggccgtgtattactgtgcgagagatcggccaataactggaaccactttggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 735 - protein, 445 aa, Artificial Sequence
  Synthetic
EVQLVESGGGLVHPGGSLRLSCAASGLTVSSNYMSWVRQAPGKGLEWVSVIYSGGSTYYADSVKGRFTISRHNSKNTLFLQMNSLRAEDTAVYYCARDRPITGTTLDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 736 - DNA, 351 bp, Artificial Sequence
  Synthetic
gaggtgcagctggtggagtctggaggaggcttggtccagcctggggggtccctgagactctcctgtgcagcctctgggttcaccgtcagtagcaactacatgaactgggtccgccaggctccagggaaggggctggagtgggtctcagttatttatagcggtggtagcacattctacgcagactccgtgaggggccgattcaccatctccagacacaattccaagaacacgctgtatcttcaaatgaacagcctgagagctgaggacacggccgtgtattactgtgcgagagatgggagcgcctacggtatggacgtctggggccaagggaccacggtcaccgtctcctca

SEQ ID NO: 737 - protein, 117 aa, Artificial Sequence
  Synthetic
EVQLVESGGGLVQPGGSLRLSCAASGFTVSSNYMNWVRQAPGKGLEWVSVIYSGGSTFYADSVRGRFTISRHNSKNTLYLQMNSLRAEDTAVYYCARDGSAYGMDVWGQGTTVTVSS

SEQ ID NO: 738 - DNA, 33 bp, Artificial Sequence
  Synthetic
gcgagagatgggagcgcctacggtatggacgtc

SEQ ID NO: 739 - protein, 11 aa, Artificial Sequence
  Synthetic
ARDGSAYGMDV

SEQ ID NO: 740 - DNA, 324 bp, Artificial Sequence
  Synthetic
gacatccagatgacccagtctccatcctccctgtctgcatctgtaggagacagagtcaccatcacttgccgggcaagtcagagcattagtagttttttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtagtcctccgatcaccttcggccaagggacacgactggagattaaa

SEQ ID NO: 741 - protein, 108 aa, Artificial Sequence
  Synthetic
DIQMTQSPSSLSASVGDRVTITCRASQSISSFLNWYQQKPGKAPKLLIYAASSLQSGVPSRFSGSGSGTDFTLTISSLQPEDFATYYCQQSYSSPPITFGQGTRLEIK

SEQ ID NO: 742 - DNA, 18 bp, Artificial Sequence
  Synthetic
cagagcattagtagtttt

SEQ ID NO: 743 - protein, 6 aa, Artificial Sequence
  Synthetic
QSISSF

SEQ ID NO: 744 - DNA, 30 bp, Artificial Sequence
  Synthetic
caacagagttacagtagtcctccgatcacc

SEQ ID NO: 745 - protein, 10 aa, Artificial Sequence
  Synthetic
QQSYSSPPIT

SEQ ID NO: 746 - DNA, 1344 bp, Artificial Sequence
  Synthetic
gaggtgcagctggtggagtctggaggaggcttggtccagcctggggggtccctgagactctcctgtgcagcctctgggttcaccgtcagtagcaactacatgaactgggtccgccaggctccagggaaggggctggagtgggtctcagttatttatagcggtggtagcacattctacgcagactccgtgaggggccgattcaccatctccagacacaattccaagaacacgctgtatcttcaaatgaacagcctgagagctgaggacacggccgtgtattactgtgcgagagatgggagcgcctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 747 - protein, 447 aa, Artificial Sequence
  Synthetic
EVQLVESGGGLVQPGGSLRLSCAASGFTVSSNYMNWVRQAPGKGLEWVSVIYSGGSTFYADSVRGRFTISRHNSKNTLYLQMNSLRAEDTAVYYCARDGSAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 748 - DNA, 648 bp, Artificial Sequence
  Synthetic
gacatccagatgacccagtctccatcctccctgtctgcatctgtaggagacagagtcaccatcacttgccgggcaagtcagagcattagtagttttttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtagtcctccgatcaccttcggccaagggacacgactggagattaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 749 - protein, 215 aa, Artificial Sequence
  Synthetic
DIQMTQSPSSLSASVGDRVTITCRASQSISSFLNWYQQKPGKAPKLLIYAASSLQSGVPSRFSGSGSGTDFTLTISSLQPEDFATYYCQQSYSSPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 750 - DNA, 1332 bp, Artificial Sequence
  Synthetic
gaggtgcagctggtggagtctggaggaggcttggtccagcctggggggtccctgagactctcctgtgcagcctctgggttcaccgtcagtagcaactacatgaactgggtccgccaggctccagggaaggggctggagtgggtctcagttatttatagcggtggtagcacattctacgcagactccgtgaggggccgattcaccatctccagacacaattccaagaacacgctgtatcttcaaatgaacagcctgagagctgaggacacggccgtgtattactgtgcgagagatgggagcgcctacggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 751 - protein, 443 aa, Artificial Sequence
  Synthetic
EVQLVESGGGLVQPGGSLRLSCAASGFTVSSNYMNWVRQAPGKGLEWVSVIYSGGSTFYADSVRGRFTISRHNSKNTLYLQMNSLRAEDTAVYYCARDGSAYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 752 - DNA, 345 bp, Artificial Sequence
  Synthetic
gaggtgcagctggtggagtctggaggaggcttggtccagcctggggggtccctgagactctcctgtgcagcctctgggttcaccgtcagtagcaactacatgagctgggtccgccaggctccagggaaggggctggagtgggtctcagttatttatagcggtggtagcacattctacgcagactccgtgaagggccgattcaccatctccagacacaattccaagaacacgctgtatcttcaaatgaacagcctgagagctgaggacacggccgtgtattactgtgcgagagagggctacggtatggacgtctggggccaagggaccacggtcaccgtctcctca

SEQ ID NO: 753 - protein, 115 aa, Artificial Sequence
  Synthetic
EVQLVESGGGLVQPGGSLRLSCAASGFTVSSNYMSWVRQAPGKGLEWVSVIYSGGSTFYADSVKGRFTISRHNSKNTLYLQMNSLRAEDTAVYYCAREGYGMDVWGQGTTVTVSS

SEQ ID NO: 754 - DNA, 27 bp, Artificial Sequence
  Synthetic
gcgagagagggctacggtatggacgtc

SEQ ID NO: 755 - protein, 9 aa, Artificial Sequence
  Synthetic
AREGYGMDV

SEQ ID NO: 756 - DNA, 1338 bp, Artificial Sequence
  Synthetic
gaggtgcagctggtggagtctggaggaggcttggtccagcctggggggtccctgagactctcctgtgcagcctctgggttcaccgtcagtagcaactacatgagctgggtccgccaggctccagggaaggggctggagtgggtctcagttatttatagcggtggtagcacattctacgcagactccgtgaagggccgattcaccatctccagacacaattccaagaacacgctgtatcttcaaatgaacagcctgagagctgaggacacggccgtgtattactgtgcgagagagggctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 757 - protein, 445 aa, Artificial Sequence
  Synthetic
EVQLVESGGGLVQPGGSLRLSCAASGFTVSSNYMSWVRQAPGKGLEWVSVIYSGGSTFYADSVKGRFTISRHNSKNTLYLQMNSLRAEDTAVYYCAREGYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 758 - DNA, 1326 bp, Artificial Sequence
  Synthetic
gaggtgcagctggtggagtctggaggaggcttggtccagcctggggggtccctgagactctcctgtgcagcctctgggttcaccgtcagtagcaactacatgagctgggtccgccaggctccagggaaggggctggagtgggtctcagttatttatagcggtggtagcacattctacgcagactccgtgaagggccgattcaccatctccagacacaattccaagaacacgctgtatcttcaaatgaacagcctgagagctgaggacacggccgtgtattactgtgcgagagagggctacggtatggacgtctggggccaagggaccacggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 759 - protein, 441 aa, Artificial Sequence
  Synthetic
EVQLVESGGGLVQPGGSLRLSCAASGFTVSSNYMSWVRQAPGKGLEWVSVIYSGGSTFYADSVKGRFTISRHNSKNTLYLQMNSLRAEDTAVYYCAREGYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 760 - DNA, 351 bp, Artificial Sequence
  Synthetic
gaggtgcagctggtggagtctggaggaggcttggtccagcctggggggtccctgagactctcctgtgcagcctctgggttaatagtcagtcgcaactacatgatctgggtccgccaggctccagggaaggggctggagtgggtctcagttatttatagcggtggtagcacattctacgcagactccgtgaagggccgattcaccatctccagacacaattccaagaacacgctgtatcttcaaatgaacagcctgagggctgaggacacggccgtatattactgtgcgagagatctgggtacaggaggtatggacgtctggggccaagggaccacggtcaccgtctcctca

SEQ ID NO: 761 - DNA, 1344 bp, Artificial Sequence
  Synthetic
gaggtgcagctggtggagtctggaggaggcttggtccagcctggggggtccctgagactctcctgtgcagcctctgggttaatagtcagtcgcaactacatgatctgggtccgccaggctccagggaaggggctggagtgggtctcagttatttatagcggtggtagcacattctacgcagactccgtgaagggccgattcaccatctccagacacaattccaagaacacgctgtatcttcaaatgaacagcctgagggctgaggacacggccgtatattactgtgcgagagatctgggtacaggaggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 762 - protein, 447 aa, Artificial Sequence
  Synthetic
EVQLVESGGGLVQPGGSLRLSCAASGLIVSRNYMIWVRQAPGKGLEWVSVIYSGGSTFYADSVKGRFTISRHNSKNTLYLQMNSLRAEDTAVYYCARDLGTGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 763 - DNA, 360 bp, Artificial Sequence
  Synthetic
caggtgcagctggtggagtctgggggaggcgtggtccagcctgggaggtccctgagactctcctgtgtagcctctggattcaccttcagtatttatggcatggactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagacctgaggacacggctgtgtattactgtgcgaaagatagggaggcagctgcggatgcttttgatatctggggccaagggacaatggtcaccgtctcttca

SEQ ID NO: 764 - protein, 120 aa, Artificial Sequence
  Synthetic
QVQLVESGGGVVQPGRSLRLSCVASGFTFSIYGMDWVRQAPGKGLEWVAVISYDGSNKYYADSVKGRFTISRDNSKNTLYLQMNSLRPEDTAVYYCAKDREAAADAFDIWGQGTMVTVSS

SEQ ID NO: 765 - DNA, 24 bp, Artificial Sequence
  Synthetic
ggattcaccttcagtatttatggc

SEQ ID NO: 766 - protein, 8 aa, Artificial Sequence
  Synthetic
GFTFSIYG

SEQ ID NO: 767 - DNA, 39 bp, Artificial Sequence
  Synthetic
gcgaaagatagggaggcagctgcggatgcttttgatatc

SEQ ID NO: 768 - protein, 13 aa, Artificial Sequence
  Synthetic
AKDREAAADAFDI

SEQ ID NO: 769 - DNA, 321 bp, Artificial Sequence
  Synthetic
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcacagtggggtcccatcaaggttcagcggcagtggatctgggacagatttcactctcaccatcagcagcctgcagcctgaagattttgcaacttactattgtcaacaggctaacagtttccgtctcactttcggcggagggaccaaggtggagatcaaa

SEQ ID NO: 770 - protein, 107 aa, Artificial Sequence
  Synthetic
DIQMTQSPSSVSASVGDRVTITCRASQGISSWLAWYQQKPGKAPKLLIYAASSLHSGVPSRFSGSGSGTDFTLTISSLQPEDFATYYCQQANSFRLTFGGGTKVEIK

SEQ ID NO: 771 - DNA, 27 bp, Artificial Sequence
  Synthetic
caacaggctaacagtttccgtctcact

SEQ ID NO: 772 - protein, 9 aa, Artificial Sequence
  Synthetic
QQANSFRLT

SEQ ID NO: 773 - DNA, 1353 bp, Artificial Sequence
  Synthetic
caggtgcagctggtggagtctgggggaggcgtggtccagcctgggaggtccctgagactctcctgtgtagcctctggattcaccttcagtatttatggcatggactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagacctgaggacacggctgtgtattactgtgcgaaagatagggaggcagctgcggatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 774 - protein, 450 aa, Artificial Sequence
  Synthetic
QVQLVESGGGVVQPGRSLRLSCVASGFTFSIYGMDWVRQAPGKGLEWVAVISYDGSNKYYADSVKGRFTISRDNSKNTLYLQMNSLRPEDTAVYYCAKDREAAADAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 775 - DNA, 645 bp, Artificial Sequence
  Synthetic
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcacagtggggtcccatcaaggttcagcggcagtggatctgggacagatttcactctcaccatcagcagcctgcagcctgaagattttgcaacttactattgtcaacaggctaacagtttccgtctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 776 - protein, 214 aa, Artificial Sequence
  Synthetic
DIQMTQSPSSVSASVGDRVTITCRASQGISSWLAWYQQKPGKAPKLLIYAASSLHSGVPSRFSGSGSGTDFTLTISSLQPEDFATYYCQQANSFRLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 777 - DNA, 1341 bp, Artificial Sequence
  Synthetic
caggtgcagctggtggagtctgggggaggcgtggtccagcctgggaggtccctgagactctcctgtgtagcctctggattcaccttcagtatttatggcatggactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagacctgaggacacggctgtgtattactgtgcgaaagatagggaggcagctgcggatgcttttgatatctggggccaagggacaatggtcaccgtctcttcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 778 - protein, 446 aa, Artificial Sequence
  Synthetic
QVQLVESGGGVVQPGRSLRLSCVASGFTFSIYGMDWVRQAPGKGLEWVAVISYDGSNKYYADSVKGRFTISRDNSKNTLYLQMNSLRPEDTAVYYCAKDREAAADAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 779 - DNA, 348 bp, Artificial Sequence
  Synthetic
gaggtgcagctggtggagtctggaggaggcttggtccagcctggggggtccctgagactctcctgtgcagcctctgggttcattgtcagtaggaactacatgagctgggtccgccaggctccagggaagggactggagtgggtctcagttatttatagcggtggtagcacattctacgcagactccgtgaagggccgcttcaccatctcccgacacaattccaagaacacgctgtatcttcaaatgaacagcctgaaagctgaggacacggccgtgtattactgtgcgagagagctacgagggtactttgactactggggccagggaaccctggtcaccgtctcctca

SEQ ID NO: 780 - protein, 116 aa, Artificial Sequence
  Synthetic
EVQLVESGGGLVQPGGSLRLSCAASGFIVSRNYMSWVRQAPGKGLEWVSVIYSGGSTFYADSVKGRFTISRHNSKNTLYLQMNSLKAEDTAVYYCARELRGYFDYWGQGTLVTVSS

SEQ ID NO: 781 - DNA, 24 bp, Artificial Sequence
  Synthetic
gggttcattgtcagtaggaactac

SEQ ID NO: 782 - protein, 8 aa, Artificial Sequence
  Synthetic
GFIVSRNY

SEQ ID NO: 783 - DNA, 30 bp, Artificial Sequence
  Synthetic
gcgagagagctacgagggtactttgactac

SEQ ID NO: 784 - protein, 10 aa, Artificial Sequence
  Synthetic
ARELRGYFDY

SEQ ID NO: 785 - DNA, 321 bp, Artificial Sequence
  Synthetic
gacatccagttgacccagtctccatccttcctgtctgcatctgtaggagacagagtcaccatcacttgctgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaactgcttaatagttacccgtacacttttggccaggggaccaagctggagatcaaa

SEQ ID NO: 786 - protein, 107 aa, Artificial Sequence
  Synthetic
DIQLTQSPSFLSASVGDRVTITCWASQGISSYLAWYQQKPGKAPKLLIYAASTLQSGVPSRFSGSGSGTEFTLTISSLQPEDFATYYCQLLNSYPYTFGQGTKLEIK

SEQ ID NO: 787 - DNA, 27 bp, Artificial Sequence
  Synthetic
caactgcttaatagttacccgtacact

SEQ ID NO: 788 - protein, 9 aa, Artificial Sequence
  Synthetic
QLLNSYPYT

SEQ ID NO: 789 - DNA, 1341 bp, Artificial Sequence
  Synthetic
gaggtgcagctggtggagtctggaggaggcttggtccagcctggggggtccctgagactctcctgtgcagcctctgggttcattgtcagtaggaactacatgagctgggtccgccaggctccagggaagggactggagtgggtctcagttatttatagcggtggtagcacattctacgcagactccgtgaagggccgcttcaccatctcccgacacaattccaagaacacgctgtatcttcaaatgaacagcctgaaagctgaggacacggccgtgtattactgtgcgagagagctacgagggtactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 790 - protein, 446 aa, Artificial Sequence
  Synthetic
EVQLVESGGGLVQPGGSLRLSCAASGFIVSRNYMSWVRQAPGKGLEWVSVIYSGGSTFYADSVKGRFTISRHNSKNTLYLQMNSLKAEDTAVYYCARELRGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 791 - DNA, 645 bp, Artificial Sequence
  Synthetic
gacatccagttgacccagtctccatccttcctgtctgcatctgtaggagacagagtcaccatcacttgctgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaactgcttaatagttacccgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 792 - protein, 214 aa, Artificial Sequence
  Synthetic
DIQLTQSPSFLSASVGDRVTITCWASQGISSYLAWYQQKPGKAPKLLIYAASTLQSGVPSRFSGSGSGTEFTLTISSLQPEDFATYYCQLLNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 793 - DNA, 1329 bp, Artificial Sequence
  Synthetic
gaggtgcagctggtggagtctggaggaggcttggtccagcctggggggtccctgagactctcctgtgcagcctctgggttcattgtcagtaggaactacatgagctgggtccgccaggctccagggaagggactggagtgggtctcagttatttatagcggtggtagcacattctacgcagactccgtgaagggccgcttcaccatctcccgacacaattccaagaacacgctgtatcttcaaatgaacagcctgaaagctgaggacacggccgtgtattactgtgcgagagagctacgagggtactttgactactggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 794 - protein, 442 aa, Artificial Sequence
  Synthetic
EVQLVESGGGLVQPGGSLRLSCAASGFIVSRNYMSWVRQAPGKGLEWVSVIYSGGSTFYADSVKGRFTISRHNSKNTLYLQMNSLKAEDTAVYYCARELRGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 795 - DNA, 351 bp, Artificial Sequence
  Synthetic
gaggtgcagctggtggagtctggaggaggcttggtccagcctggggggtccctgagactctcctgtgcagcctctgggttcaccgtcagtagtaactacatgacctgggtccgccaggctccagggaaggggctggagtgggtctcagttatttatagcggtggtagcacattctacgcagactccgtgaagggccgattcaccatctccagacacaattccgagaacacgctgtatcttcaaatgaacagcctgagagctgaggacacggccgtgtattactgtgcgagagatctagcagcagctggtacagactactggggccagggagccctggtcaccgtctcctca

SEQ ID NO: 796 - protein, 117 aa, Artificial Sequence
  Synthetic
EVQLVESGGGLVQPGGSLRLSCAASGFTVSSNYMTWVRQAPGKGLEWVSVIYSGGSTFYADSVKGRFTISRHNSENTLYLQMNSLRAEDTAVYYCARDLAAAGTDYWGQGALVTVSS

SEQ ID NO: 797 - DNA, 33 bp, Artificial Sequence
  Synthetic
gcgagagatctagcagcagctggtacagactac

SEQ ID NO: 798 - protein, 11 aa, Artificial Sequence
  Synthetic
ARDLAAAGTDY

SEQ ID NO: 799 - DNA, 321 bp, Artificial Sequence
  Synthetic
gacatccagttgacccagtctccatccttcctgtctgcatctgtaggagacagagtcaccatcacttgctgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgatgattttgcaacttattactgtcaacaccttaatagttacctgtacacttttggccaggggaccaagctggagatcaaa

SEQ ID NO: 800 - protein, 107 aa, Artificial Sequence
  Synthetic
DIQLTQSPSFLSASVGDRVTITCWASQGISSYLAWYQQKPGKAPKLLIYAASTLQSGVPSRFSGSGSGTEFTLTISSLQPDDFATYYCQHLNSYLYTFGQGTKLEIK

SEQ ID NO: 801 - DNA, 27 bp, Artificial Sequence
  Synthetic
caacaccttaatagttacctgtacact

SEQ ID NO: 802 - protein, 9 aa, Artificial Sequence
  Synthetic
QHLNSYLYT

SEQ ID NO: 803 - DNA, 1344 bp, Artificial Sequence
  Synthetic
gaggtgcagctggtggagtctggaggaggcttggtccagcctggggggtccctgagactctcctgtgcagcctctgggttcaccgtcagtagtaactacatgacctgggtccgccaggctccagggaaggggctggagtgggtctcagttatttatagcggtggtagcacattctacgcagactccgtgaagggccgattcaccatctccagacacaattccgagaacacgctgtatcttcaaatgaacagcctgagagctgaggacacggccgtgtattactgtgcgagagatctagcagcagctggtacagactactggggccagggagccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 804 - protein, 447 aa, Artificial Sequence
  Synthetic
EVQLVESGGGLVQPGGSLRLSCAASGFTVSSNYMTWVRQAPGKGLEWVSVIYSGGSTFYADSVKGRFTISRHNSENTLYLQMNSLRAEDTAVYYCARDLAAAGTDYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 805 - DNA, 645 bp, Artificial Sequence
  Synthetic
gacatccagttgacccagtctccatccttcctgtctgcatctgtaggagacagagtcaccatcacttgctgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgatgattttgcaacttattactgtcaacaccttaatagttacctgtacacttttggccaggggaccaagctggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 806 - protein, 214 aa, Artificial Sequence
  Synthetic
DIQLTQSPSFLSASVGDRVTITCWASQGISSYLAWYQQKPGKAPKLLIYAASTLQSGVPSRFSGSGSGTEFTLTISSLQPDDFATYYCQHLNSYLYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 807 - DNA, 1332 bp, Artificial Sequence
  Synthetic
gaggtgcagctggtggagtctggaggaggcttggtccagcctggggggtccctgagactctcctgtgcagcctctgggttcaccgtcagtagtaactacatgacctgggtccgccaggctccagggaaggggctggagtgggtctcagttatttatagcggtggtagcacattctacgcagactccgtgaagggccgattcaccatctccagacacaattccgagaacacgctgtatcttcaaatgaacagcctgagagctgaggacacggccgtgtattactgtgcgagagatctagcagcagctggtacagactactggggccagggagccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 808 - protein, 443 aa, Artificial Sequence
  Synthetic
EVQLVESGGGLVQPGGSLRLSCAASGFTVSSNYMTWVRQAPGKGLEWVSVIYSGGSTFYADSVKGRFTISRHNSENTLYLQMNSLRAEDTAVYYCARDLAAAGTDYWGQGALVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 809 - DNA, 360 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagttataagtactatgcagactccgtgaagggccgattcaccatctccagagacaattccaagaacacgctgtatctgcaaatgaacagcctgagagctgaggacacggctgtgtattactgtgcgatagatggggggacagtgactacgatttttgactactggggccagggaaccctggtcaccgtctcctca

SEQ ID NO: 810 - protein, 120 aa, Artificial Sequence
  Synthetic
QVQLVESGGGVVQPGRSLRLSCAASGFTFSSYGMHWVRQAPGKGLEWVAVISYDGSYKYYADSVKGRFTISRDNSKNTLYLQMNSLRAEDTAVYYCAIDGGTVTTIFDYWGQGTLVTVSS

SEQ ID NO: 811 - DNA, 24 bp, Artificial Sequence
  Synthetic
ggattcaccttcagtagctatggc

SEQ ID NO: 812 - protein, 8 aa, Artificial Sequence
  Synthetic
GFTFSSYG

SEQ ID NO: 813 - DNA, 24 bp, Artificial Sequence
  Synthetic
atatcatatgatggaagttataag

SEQ ID NO: 814 - protein, 8 aa, Artificial Sequence
  Synthetic
ISYDGSYK

SEQ ID NO: 815 - DNA, 39 bp, Artificial Sequence
  Synthetic
gcgatagatggggggacagtgactacgatttttgactac

SEQ ID NO: 816 - protein, 13 aa, Artificial Sequence
  Synthetic
AIDGGTVTTIFDY

SEQ ID NO: 817 - DNA, 324 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatactgcatccagtttgcaaagtggggtcccatcaaggttcagtggcagtggatctgggacagatttcactctcaccatcagcagtctgcaacctgaagattttgcaacttactactgtcaacagagttacagtacccctccgtggacgttcggccaagggaccaaggtggaaatcaaa

SEQ ID NO: 818 - protein, 108 aa, Artificial Sequence
  Synthetic
DIQMTQSPSSLSASVGDRVTITCRASQSISSYLNWYQQKPGKAPKLLIYTASSLQSGVPSRFSGSGSGTDFTLTISSLQPEDFATYYCQQSYSTPPWTFGQGTKVEIK

SEQ ID NO: 819 - DNA, 9 bp, Artificial Sequence
  Synthetic
actgcatcc

SEQ ID NO: 820 - protein, 3 aa, Artificial Sequence
  Synthetic
TAS

SEQ ID NO: 821 - DNA, 30 bp, Artificial Sequence
  Synthetic
caacagagttacagtacccctccgtggacg

SEQ ID NO: 822 - protein, 10 aa, Artificial Sequence
  Synthetic
QQSYSTPPWT

SEQ ID NO: 823 - DNA, 1353 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagttataagtactatgcagactccgtgaagggccgattcaccatctccagagacaattccaagaacacgctgtatctgcaaatgaacagcctgagagctgaggacacggctgtgtattactgtgcgatagatggggggacagtgactacgatttttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagtccctctccctgtctccgggtaaatga

SEQ ID NO: 824 - protein, 450 aa, Artificial Sequence
  Synthetic
QVQLVESGGGVVQPGRSLRLSCAASGFTFSSYGMHWVRQAPGKGLEWVAVISYDGSYKYYADSVKGRFTISRDNSKNTLYLQMNSLRAEDTAVYYCAIDGGTVTTIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 825 - DNA, 648 bp, Artificial Sequence
  Synthetic
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatactgcatccagtttgcaaagtggggtcccatcaaggttcagtggcagtggatctgggacagatttcactctcaccatcagcagtctgcaacctgaagattttgcaacttactactgtcaacagagttacagtacccctccgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 826 - protein, 215 aa, Artificial Sequence
  Synthetic
DIQMTQSPSSLSASVGDRVTITCRASQSISSYLNWYQQKPGKAPKLLIYTASSLQSGVPSRFSGSGSGTDFTLTISSLQPEDFATYYCQQSYSTPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 827 - DNA, 1341 bp, Artificial Sequence
  Synthetic
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagttataagtactatgcagactccgtgaagggccgattcaccatctccagagacaattccaagaacacgctgtatctgcaaatgaacagcctgagagctgaggacacggctgtgtattactgtgcgatagatggggggacagtgactacgatttttgactactggggccagggaaccctggtcaccgtctcctcagcctccaccaagggcccatcggtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccaccgtgcccagcaccaggcggtggcggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctcaccgtggacaagagcaggtggcaggaggggaatgtcttctcatgctccgtgatgcatgaggctctgcacaaccactacacacagaagtccctctccctgtctctgggtaaatga

SEQ ID NO: 828 - protein, 446 aa, Artificial Sequence
  Synthetic
QVQLVESGGGVVQPGRSLRLSCAASGFTFSSYGMHWVRQAPGKGLEWVAVISYDGSYKYYADSVKGRFTISRDNSKNTLYLQMNSLRAEDTAVYYCAIDGGTVTTIFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPGGGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 829 - protein, 251 aa, Artificial Sequence
  Synthetic
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFEQKLISEEDLGGEQKLISEEDLHHHHHH

SEQ ID NO: 830 - protein, 456 aa, Artificial Sequence
  Synthetic
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 831 - protein, 450 aa, Artificial Sequence
  Synthetic
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 832 - protein, 1273 aa, Artificial Sequence
  Synthetic
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 833 - protein, 1196 aa, Artificial Sequence
  Synthetic
VNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIK

SEQ ID NO: 834 - protein, 5 aa, Artificial Sequence
  Synthetic
GGGGS

SEQ ID NO: 835 - protein, 47 aa, Artificial Sequence
  Synthetic
DISTEIYQAGSTPCNGVEGFNCYFPLQSYGFQPTNGVGYQPYRVVVL

SEQ ID NO: 836 - protein, 21 aa, Artificial Sequence
  Synthetic
CVIAWNSNNLDSKVGGNYNYL

SEQ ID NO: 837 - protein, 8 aa, Artificial Sequence
  Synthetic
DISTEIYQ

SEQ ID NO: 838 - protein, 34 aa, Artificial Sequence
  Synthetic
CNGVEGFNCYFPLQSYGFQPTNGVGYQPYRVVVL

SEQ ID NO: 839 - protein, 44 aa, Artificial Sequence
  Synthetic
DISTEIYQAGSTPCNGVEGFNCYFPLQSYGFQPTNGVGYQPYRV

SEQ ID NO: 840 - protein, 16 aa, Artificial Sequence
  Synthetic
EIYQAGSTPCNGVEGF

SEQ ID NO: 841 - protein, 25 aa, Artificial Sequence
  Synthetic
PLQSYGFQPTNGVGYQPYRVVVLSF

SEQ ID NO: 842 - protein, 10 aa, Artificial Sequence
  Synthetic
YAWNRKRISN

SEQ ID NO: 843 - protein, 20 aa, Artificial Sequence
  Synthetic
DISTEIYQAGSTPCNGVEGF

SEQ ID NO: 844 - protein, 23 aa, Artificial Sequence
  Synthetic
PLQSYGFQPTNGVGYQPYRVVVL

SEQ ID NO: 845 - protein, 23 aa, Artificial Sequence
  Synthetic
FVIRGDEVRQIAPGQTGKIADYN

SEQ ID NO: 846 - protein, 34 aa, Artificial Sequence
  Synthetic
YRLFRKSNLKPFERDISTEIYQAGSTPCNGVEGF

SEQ ID NO: 847 - protein, 26 aa, Artificial Sequence
  Synthetic
FPLQSYGFQPTNGVGYQPYRVVVLSF

SEQ ID NO: 848 - protein, 24 aa, Artificial Sequence
  Synthetic
VIRGDEVRQIAPGQTGKIADYNYK

SEQ ID NO: 849 - protein, 43 aa, Artificial Sequence
  Synthetic
EIYQAGSTPCNGVEGFNCYFPLQSYGFQPTNGVGYQPYRVVVL

SEQ ID NO: 850 - protein, 14 aa, Artificial Sequence
  Synthetic
YAWNRKRISNCVAD

SEQ ID NO: 851 - protein, 1261 aa, Artificial Sequence
  Synthetic
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKGYIPEAPRDGQAYVRKDGEWVLLSTFLGSLVPRGSEQKLISEEDLGGEQKLISEEDLHHHHHH

We claim:

1. A method for selecting a plurality of antibodies or antigen-binding fragments thereof for use in mitigating a frequency of escape mutants of a SARS-CoV-2 virus, comprising:

a) obtaining a first antibody or antigen-binding fragment thereof that binds to a first epitope of a SARS-CoV-2 spike glycoprotein, the first epitope comprising the amino sequence set forth in SEQ ID NO: 836;

b) obtaining a second antibody or antigen-binding fragment thereof that binds to a second epitope of the SARS-CoV-2 spike glycoprotein, the second epitope comprising the amino sequence set forth in SEQ ID NO: 839;

c) determining whether said first antibody or antigen-binding fragment thereof and said second antibody or antigen-binding fragment thereof each exhibit neutralization potency against said virus;

d) determining whether said first antibody or antigen-binding fragment thereof competes with said second antibody or antigen-binding fragment thereof for binding to said surface protein;

e) if said first antibody or antigen-binding fragment thereof and said second antibody or antigen-binding fragment thereof each exhibit neutralization potency against said virus, and if said first antibody or antigen-binding fragment thereof and said second antibody or antigen-binding fragment thereof do not compete for binding to said surface protein, proceeding to steps f)-i);

f) determining a first frequency of escape mutants resulting from said first antibody or antigen-binding fragment thereof alone;

g) determining a second frequency of escape mutants resulting from said second antibody or antigen-binding fragment thereof alone;

h) determining a third frequency of escape mutants resulting from a combination of said first antibody or antigen-binding fragment thereof and said second antibody or antigen-binding fragment thereof; and i) selecting said combination for use in mitigating the frequency of escape mutants if said third frequency is lower than said first frequency and said second frequency;

wherein said escape mutants are mutants in said SARS-CoV-2 spike protein.

2. The method of claim 1, wherein said frequency of escape mutants is measured by:

a) contacting a population of cells with said first antibody or antigen-binding fragment thereof, and with a virus expressing said SARS-CoV-2 spike protein, sequencing nucleic acids from said population of cells, and determining a first frequency of SARS-CoV-2 spike protein mutations;

b) contacting a comparable population of cells with said second antibody or antigen-binding fragment thereof, and with a virus expressing said SARS-CoV-2 spike protein, sequencing nucleic acids from said population of cells, and determining a second frequency of SARS-CoV-2 spike protein mutations;

c) contacting a comparable population of cells with said first antibody or antigen-binding fragment thereof and said second antibody or antigen-binding fragment thereof, and with a virus expressing said SARS-CoV-2 spike protein, sequencing nucleic acids from said population of cells, and determining a third frequency of SARS-CoV-2 spike protein mutations; and d) comparing said first frequency, said second frequency, and said third frequency.

* * * * *